United States Patent
Huang et al.

(10) Patent No.: US 7,504,211 B2
(45) Date of Patent: *Mar. 17, 2009

(54) METHODS OF USING EPHA2 FOR PREDICTING ACTIVITY OF COMPOUNDS THAT INTERACT WITH AND/OR MODULATE PROTEIN TYROSINE KINASES AND/OR PROTEIN TYROSINE KINASE PATHWAYS IN BREAST CELLS

(75) Inventors: Fei Huang, Princeton, NJ (US); Xia Han, Somerset, NJ (US); Karen A. Reeves, Ewing, NJ (US); Lukas C. Amler, Pennington, NJ (US); Craig R. Fairchild, Yardley, PA (US); Francis Y. Lee, Yardley, PA (US); Peter Shaw, Yardley, PA (US)

(73) Assignee: Bristol-Myers Squibb Company, Princeton, NY (US)

( * ) Notice: Subject to any disclaimer, the term of this patent is extended or adjusted under 35 U.S.C. 154(b) by 0 days.

This patent is subject to a terminal disclaimer.

(21) Appl. No.: 10/648,593

(22) Filed: Aug. 26, 2003

(65) Prior Publication Data

US 2004/0106132 A1    Jun. 3, 2004

Related U.S. Application Data

(60) Provisional application No. 60/406,385, filed on Aug. 27, 2002.

(51) Int. Cl.
*C12Q 1/00* (2006.01)
*C12Q 1/68* (2006.01)
(52) U.S. Cl. .............................. 435/6; 435/4
(58) Field of Classification Search ........................ None
See application file for complete search history.

(56) References Cited

U.S. PATENT DOCUMENTS

| | | | |
|---|---|---|---|
| 5,569,588 | A | 10/1996 | Ashby et al. |
| 2004/0106132 | A1 | 6/2004 | Huang et al. |
| 2005/0079518 | A1 | 4/2005 | Baker et al. |
| 2006/0019284 | A1 | 1/2006 | Huang et al. |
| 2006/0029971 | A1 | 2/2006 | Golub et al. |

FOREIGN PATENT DOCUMENTS

| | | |
|---|---|---|
| WO | WO00/62778 | 10/2000 |
| WO | WO02/50306 A1 | 6/2002 |
| WO | WO03/062395 A2 | 7/2003 |
| WO | WO2004/020583 A2 | 3/2004 |
| WO | WO2004/085388 A2 | 10/2004 |
| WO | WO2006/005035 A2 | 1/2006 |
| WO | PCT/US2006/060776 | 11/2006 |

OTHER PUBLICATIONS

GenBank Accession No. NM_004431 Fang et al. Jan. 8, 2006. Alignment with SEQ ID No. 1.*

Fernandez-Trigo et al., Prognostic implications of chemoresistance-sensitivity assays for colorectal and appendiceal cancer.Am J Clin Oncol. Oct. 1995;18(5):454-60.*

Kassenbrock et al., Inhibition of Src family kinases blocks epidermal growth factor (EGF)-induced activation of Akt, phosphorylation of c-Cbl, and ubiquitination of the EGF receptor. J Biol Chem. Jul. 12, 2002;277(28):24967-75. Epub May 6, 2002.*

Wang et al., Negative regulation of EphA2 receptor by Cbl. Biochem Biophys Res Commun. Aug. 9, 2002;296(1):214-20.*

Woll et al., Uveal melanoma: natural history and treatment options for metastatic disease.Melanoma Res. Dec. 1999;9(6):575-81. Review.*

Ogawa et al., The ephrin-A1 ligand and its receptor, EphA2, are expressed during tumor neovascularization. Oncogene. Dec. 7, 2000;19(52):6043-52.*

Hanke et al, Discovery of a novel, potent, and Src family-selective tyrosine kinase inhibitor. Study of Lck- and FynT-dependent T cell activation. J Biol Chem. Jan. 12, 1996;271(2):695-701.*

Tatton et al, The Src-selective kinase inhibitor PP1 also inhibits Kit and Bcr-Abl tyrosine kinases. J Biol Chem. Feb. 14, 2003;278(7):4847-53. Epub Dec. 9, 2002.*

Waltenberger et al, A dual inhibitor of platelet-derived growth factor beta-receptor and Src kinase activity potently interferes with motogenic and mitogenic responses to PDGF in vascular smooth muscle cells. A novel candidate for prevention of vascular remodeling. Circ Res. Jul. 9, 1999;85(1):12-22.*

Zelinski et al, EphA2 overexpression causes tumorigenesis of mammary epithelial cells. Cancer Res. Mar. 1, 2001;61(5):2301-6.*

Carles-Kinch et al, Antibody targeting of the EphA2 tyrosine kinase inhibits malignant cell behavior. Cancer Res. May 15, 2002;62(10):2840-7.*

Sotiriou et al, Taking gene-expression profiling to the clinic: when will molecular signatures become relevant to patient care? Nat Rev Cancer. Jul. 2007;7(7):545-53. Review.*

Gruvberger-Saal et al, Microarrays in breast cancer research and clinical practice—the future lies ahead. Endocr Relat Cancer. Dec. 2006;13(4):1017-31. Review.*

(Continued)

*Primary Examiner*—Sheridan Swope
(74) *Attorney, Agent, or Firm*—Stephen C. D'Amico

(57) ABSTRACT

The present invention describes polynucleotides that have been discovered to correlate to the relative sensitivity or resistance of cells, e.g., breast cell lines, to treatment with compounds that interact with and modulate, e.g., inhibit, protein tyrosine kinases, such as, for example, members of the Src family of tyrosine kinases, e.g., Src, Fgr, Fyn, Yes, Blk, Hck, Lck and Lyn, as well as other protein tyrosine kinases, including, Bcr-abl, Jak, PDGFR, c-kit and Eph receptors. These polynucleotides have been shown to have utility in predicting the resistance and sensitivity of breast cell lines to the compounds. Such polynucleotides comprise polynucleotide predictor or marker sets useful in methods of predicting drug response, and as prognostic or diagnostic indicators in disease management, particularly in those disease areas, e.g., breast cancer, in which signaling through one or more of the aforementioned Src tyrosine and protein tyrosine kinases is involved with the disease process.

1 Claim, 9 Drawing Sheets
(4 of 9 Drawing Sheet(s) Filed in Color)

OTHER PUBLICATIONS

Cockett, et al., "Applied genomics:integration of the technology within pharmaceutical research and development", Current Opinion in Biotech, vol. 11, pp. 602-609 (2000).
Sonneveld, P., "Multidrug resistance in haematological malignancies", J. Internal Med., vol. 247, pp. 521-534 (2000).
Alizadeh, et al., "Distinct types of diffuse large B-cell lymphoma identifie by gene expression profiling", Nature, vol. 403, pp. 503-511 (2000).
Bittner, et al., "Molecular classification of cutaneous malignant melanoma by gene expression profiling", Nature, vol. 406, pp. 536-540 (2000).
van't Veer, et al., "Gene expression profiling predicts clinical outcome of breast cancer", Nature, vol. 15, pp. 530-536 (2002).
Khan, et al., "Classification and diagnostic prediction of cancers using gene expression profiling and artificial neural networks", Nature Medicine, vol. 7, pp. 673-679 (2001).
Shipp, et al., "Diffuse large B-cell lymphoma outcome prediction by gene-expression profiling and supervised machine learning", Nature Medicine, vol. 8, pp. 68-74 (2002).
Golub, et al., "Molecular Classification of Cancer: Class Discovery and Class Prediction by Gene Expression Monitoring", Science, vol. 286, pp. 531-537 (1999).
Alon, et al., "Broad patterns of gene expression revealed by clustering analysis of tumor and normal colon tissues probed by oligonucleotide arrays", PNAS, vol. 96, pp. 6745-6750 (1999).
West, et al., "Predicting the clinical status of human breast cancer by using gene expression profiles", PNAS, vol. 98(20), pp. 11462-11467 (2001).
Sorlie, et al., "Gene expression patterns of breast carcinomas distinguish tumor subclasses with clinical implications", PNAS, vol. 98(19), pp. 10869-10874 (2001).
Blanchard, et al., "Sequence to array: Probing the genome's secrets", Nature Biotechnology, vol. 14, pp. 1649 (1996).
Khan, et al., "Gene Expression Profiling of Alveolar Rhabdomyosarcoma with cDNA Microarrays", Cancer Res., vol. 58, pp. 5009-5013 (1998).
Lockhart, et al., "Expression monitoring by hybridization to high-density oligonucleotide arrays", Nature Biotechnology, vol. 14, pp. 1675-1680 (1996).
Freeman, et al., "Fundamentals of DNA Hybridization Arrays for Gene Expression Analysis", BioTechniques, vol. 29, pp. 1042-1055 (2000).
Schena, et al., "Quantitative Monitoring of Gene Expression Patterns with a Complementary DNA Microarray", Science, vol. 270, pp. 467-470 (1995).
Ellis, et al., "Down-regulation of Vascular Endothelial Growth Factor in a Human Colon Carcinoma Cell Line Transfected with an Antisense Expression Vector Specific for c-src", J. Biol. Chem., vol. 273(2), pp. 1052-1057 (1998).
Baselga, et al., "Phase II Study of Weekly Intravenous Recombinant Humanized Anti-p185[HER2] Monoclonal Antibody in Patients with HER2/neu-Overexpressing Metastatic Breast Cancer", J. Clin. Oncol., vol. 14(3), pp. 737-744 (1996).
Bild, et al., "Oncogenic Pathway Signatures in Human Cancers as a Guide to Targeted Therapies", Nature, vol. 439, pp. 353-357 (2006).
Brenton, et. al., "Molecular Classification and Molecular Forecasting of Breast Cancer: Ready for Clinical Application?", J. Clin. Oncol., vol. 23(29), pp. 7350-7360 (2005).
Burgess, et al., "Comparative Analysis of Two Clinically Active BCR-ABL Kinase Inhibitors Reveals the Role of Conformation-Specific Binding in Resistance", PNAS, vol. 102, pp. 3395-3400 (2005).
Carlini, et al., UGT1A7 and UGT1A9 Polymorphisms Predict Response and Toxicity in Colorectal Cancer Patients Treated with Capecitabine/Irinotecanrn, Clin. Can. Res., vol. 11, pp. 1226-1236 (2005).
Dressman, et al., "Gene Expression Profiles of Multiple Breast Cancer Phenotypes and Response to Neoadjuvant Chemotherapy", Clin. Can. Res., vol. 12(3), pp. 819-826 (2006).
Duxbury, et al., "CEACAM6 Cross-linking Induces Caveolin-1-dependent, Src-mediated Focal Adhesion Kinase Phosphorylation in BxPC3 Pancreatic Adenocarcinoma Cells", J. Biol. Chem., vol. 279(22), pp. 23176-23182 (2004).
Biscardi, et al., "c-SRC, Receptor Tyrosine Kinases, and Human Cancer", Adv. Can. Res., vol. 9(6), pp. 61-119 (1999).
Eliceiri, et al., "Selective Requirement for Src Kinases during VEGF-Induced Angiogenesis and Vascular Permeability", Molec. Cell, vol. 4, pp. 915-924 (1999).
Finn, et al., "Biologic Effects and Identification of Predictive Markers of Response to Dasatinib (BMS-354825), a Novel, Oral, Multi-targeted Kinase Inhibitor in Human Breast Cancer Cell Lines in vitro", Clin. Can. Res., vol. 11(24), pp. 9022s (2005).
Giancotti, et al., "Integrin Signaling", Science, vol. 285, pp. 1028-1032 (1999).
Horne, et al., "The Role(s) of Src Kinase and Cbl Proteins in the Regulation of Osteoclast Differentiation and Function", Immunol. Rev., vol. 208, pp. 106-125 (2005).
Iwao-Koizumi, et al., "Prediction of Docetaxel Response in Human Breast Cancer by Gene Expression Profiling", J. Clin. Oncol., vol. 23(3), pp. 422-431 (2005).
Johnson, et al., "Dasatinib (BMS-354825) Tyrosine Kinase Inhibitor Suppresses Invasion and Induces Cell Cycle Arrest and Apoptosis of Head and Neck Squamous Cell Carcinoma and Non-Small Cell Lung Cancer Cells", Clin. Can. Res., vol. 11(19), pp. 6924-6932 (2005).
Landen, et al., "EphA2 as a Target for Ovarian Cancer Therapy", Expert Opin. Ther. Targets, vol. 9(6), pp. 1179-1187 (2005).
Lynch, et al., "Activating Mutations in the Epidermal Growth Factor Receptor Underlying Responsiveness of Non-Small-Cell Lung Cancer to Gefitinib", New Engl. J. Med., vol. 350(21), pp. 2129/2139 (2004).
Mao, et al., "Activation of c-Src by Receptor Tyrosine Kinases in Human Colon Cancer Cells with High Metastatic Potential", Oncogene, vol. 15, pp. 3083-3090 (1997).
Mariadason, et. al., "Gene Expression Profiling-Based Prediction of Response of Colon Carcinoma Cells to 5-Fluorouracil and Camptothecin", Can. Res., vol. 63, pp. 8791-8812 (2003).
Myoui, et al., "C-Src Tyrosine Kinase Activity Is Associated with Tumor Colonization in Bone and Lung in an Animal Model of Human Breast Cancer Metastasis", Can. Res., vol. 63, pp. 5028-5033 (2003).
Nam, et al., "Action of the Src Family Kinase Inhibitor, Dasatinib (BMS-354825), on Human Prostate Cancer Cells", Can. Res., vol. 65(20), pp. 9185-9189 (2005).
Pao, et al., "EGF Receptor Gene Mutations are Common in Lung Cancers from 'Never Smokers' and are Associated with Sensitivity of Tumors to Gefitinib and Erlotinib", PNAS, vol. 101, pp. 13306-13311 (2004).
Pawitan, et al., "Gene Expression Profiling Spares Early Breast Cancer Patients from Adjuvant Therapy: Derived and Validated in Two Population-Based Cohorts", Breast Can. Res., vol. 7, pp. R953-R964 (2005).
Perou, et al., "Molecular Portraits of Human Breast Tumours", Nature, vol. 406, pp. 747-752 (2000).
Peters, et al., "Genome-wide Transcriptional Analysis of Carboplatin Response in Chemoensitive and Chemoresistant Ovarian Cancer Cells", Mol. Can. Ther., vol. 4(10), pp. 1605-1616 (2005).
Roberts, et al., "Identification of Genes Associated with Platinum Drug Sensitivity and Resistance in Human Ovarian Cancer Cells", Brit. J. Can., vol. 92, pp. 1149-1158 (2005).
Rouzier, et al., "Microtubule-associated Protein Tau: A Marker of Paclitaxel Sensitivity in Breast Cancer", PNAS, vol. 102, pp. 8315-8320 (2005).
Shah, et al., "Overriding Imatinib Resistance with a Novel ABL Kinase Inhibitor", Science, vol. 305, pp. 399-401 (2004).
Shah, et al., "BMS-354825: a Novel Drug with Potential for the Treatment of Imatinib-Resistant Chronic Myeloid Leukaemia", Expert Opin. Investig. Drugs, vol. 14(1), pp. 89-91 (2005).
Staunton, et al., "Chemosensitivity Prediction by Transcriptional Profiling", PNAS, vol. 98, pp. 10787-10792 (2001).
Susa, et al., "Src Inhibitors: Drugs for the Treatment of Osteoporosis, Cancer or Both", TIPS, vol. 21, pp. 489-495 (2000).
Talpaz, et al., "Dasatinib in Imatinib-Resistant Philadelphia Chromosone-Positive Leukemias", N. Engl. J. Med., vol. 354, pp. 2531-2541 (2006).

Thomas, et al., "Cellular Functions Regulated by SRC Family Kinases", Annu. Rev. Cell Dev. Biol., vol. 13, pp. 513-609 (1997).

Van de Rijn, et al., "Expression of Cytokeratins 17 and 5 Identifies a Group of Breast Carcinomas with Poor Clinical Outcome", Am. J. Path., vol. 161(6), pp. 1991-1996 (2002).

Vekris, et al., "Molecular Determinants of the Cytotoxicity of Platinum Compounds: The Contribution of in Silico Research", Can. Res., vol. 64, pp. 356-362 (2004).

Verbeek, et al., "c-Src Protein Expression is Increased in Human Breast Cancer. An Immunohistochemical and Biochemical Analysis", J. Path., vol. 180, pp. 383-388 (1996).

Warmuth, et al., "Src Family Kinases: Potential Targets for the Treatment of Human Cancer and Leukemia", Curr. Pharm. Design, vol. 9, pp. 2043-2059 (2003).

Weis, et al., "Endothelial Barrier Disruption by VEGF-Mediated Src Activity Potentiates Tumor Cell Extravasation and Metastasis", J. Cell Biol., vol. 167(2), pp. 223-229 (2004).

Yamanashi, et a., "The yes-Related Cellular Gene *lyn* Encodes a Possible Tyrosine Kinase Similar to p56$^{lck}$", Molec. Cell. Biol., vol. 7(1), pp. 237-243 (1987).

U.S. Appl. No. 10/348,119, filed Jan. 17, 2003, Huang, et al.

U.S. Appl. No. 11/169,041, filed Jun. 28, 2005, Huang, et al.

Aasheim, et al., "A Splice Variant of Human Ephrin-A4 Encodes a Soluble Molecule that is Secreted by Activated Human B Lymphocytes", Blood, vol. 95(1), pp. 221-230 (2000).

Abraham, et al., "Expression of EphA2 and Ephrin A-1 in Carcinoma of the Urinary Bladder", Clin. Cancer Res., vol. 12(2), pp. 353-360 (2006).

Alves, et al., "EphA2 as Target of Anticancer Immunotherapy: Identification of HLA-A *0201-Restricted Epitopes", Cancer Res., vol. 63, pp. 8476-8480 (2003).

Blume-Jensen, et al., "Oncogenic Kinase Signalling", Nature, vol. 411, pp. 355-365 (2001).

Brantley, et al., "Soluble Eph A Receptors Inhibit Tumor Angiogenesis and Progression in vivo", Oncogene, vol. 21, pp. 7011-7026 (2002).

Brown, et al., "Regulation, Substrates and Functions of SRC", Biochimica et Biophys. Acta., vol. 1287, pp. 121-149 (1996).

Cheng, et al., "Blockade of EphA Receptor Tyrosine Kinase Activation Inhibits Vascular Endothelial Cell Growth Factor-Induced Angiogenesis", Molec. Cancer Res., vol. 1, pp. 2-11 (2002).

Davis, et al., "Ligands for EPH-Related Receptor Tyrosine Kinases That Require Membrane Attachment or Clustering for Activity", Science, vol. 266, pp. 816-819 (1994).

de Saint-Vis, et al., "Human Dendritic Cells Express Neuronal Eph Receptor Tyrosine Kinases: Role of EphA2 in Regulating Adhesion to Fibronectin", Blood, vol. 102(13), pp. 4431-4440 (2003).

Duxbury, et al., "Ligation of EphA2 by Ephrin A1-Fc inhibits pancreatic adenocarcinoma cellular invasiveness", Biochem. Biophysical Res. Comm., vol. 320, pp. 1096-1102 (2004).

Fang, et al., "A Kinase-Dependent Role for EphA2 Receptor in Promoting Tumor Growth and Metastasis", Oncogene, vol. 24, pp. 7859-7868 (2005).

Flanagan, et al., "The Ephrins and EPH Receptors in Neural Development", Annu. Rev. Neurosci, vol. 21, pp. 309-345 (1998).

Frame, M.C., "Src in Cancer: Deregulation and Consequences for Cell Behaviour", Biochimica et Biophys. Acta, vol. 1602, pp. 114-130 (2002).

Gale, et al., "Eph Receptors and Ligands Comprise Two Major Specificity Subclasses and Are Reciprocally Compartmentalized during Embryogenesis", Neuron, Vo. 17, pp. 9-19 (1996).

Ganju, et al., "The Eck Receptor Tyrosine Kinase is Implicated in Pattern Formation during Gastrulation, hindbrain segmentation and limb development", Oncogene, vol. 9, pp. 1613-1624 (1994).

Goldman-Wohl, et al., "Eph and Ephrin Expression in Normal Placental Development and Preeclampsia", Placenta, vol. 25, pp. 623-630 (2004).

Herath, et al., "Over-Expression of Eph and Ephrin Genes in Advanced Ovarian Cancer: Ephrin Gene Expression Correlates with Shortened Survival", BMC Cancer, vol. 6, pp. 144 (2006).

Herrem, et al., "Expression of EphA2 is Prognostic of Disease-Free Interval and Overall Survival in Surgically Treated Patients with Renal Cell Carcinoma", vol. 11, pp. 226-231 (2005).

Hess, et al., "VE-Cadherin Regulates EphA2 in Aggressive Melanoma Cells Through a Novel Signaling Pathway", Cancer Biol. Therapy, vol. 5(2), pp. 228-233 (2006).

Holder, et al., "Eph Receptors and Ephrins: Effectors of Morphogenesis", Development, vol. 126, pp. 2033-2044 (1999).

Hu, et al., "EphA2 Induction of Fibronectin Creates a Permissive Microenvironment for Malignant Cells", Mol Cancer Res,., vol. 2(10), pp. 533-540 (2004).

Hynes, N.E., "Tyrosine Kinase Signalling in Breast Cancer", Breast Cancer Res., vol. 2, pp. 154-157 (2000).

Kalo, et al., "Signal Transfer by Eph Receptors", Cell Tissue Res., vol. 298, pp. 1-9 (1999).

Kataoka, et al., "Correlation of EPHA2 Overexpression with High Microvessel Count in Human Primary Colorectal Cancer", Cancer Sci., vol. 95(2), pp. 136-141 (2004).

Kikawa, et al., "Regulation of the EphA2 Kinase by the Low Molecular Weight Tyrosine Phosphatase Induces Transformation", J. Biol. Chem., vol. 277(42), pp. 39274-39279 (2002).

Kinch, et al., "Overexpression and Functional Alterations of the EphA2 Tyrosine Kinase in Cancer", Clin. Exper. Metastasis, vol. 20, pp. 59-68 (2003).

Kinch, et al., "Predictive Value of the EphA2 Receptor Tyrosine Kinase in Lung Cancer Recurrence and Survival", Clin. Cancer Res., vol. 9, pp. 613-618 (2003).

Koolpe, et al., "An Ephrin Mimetic Peptide That Selectively Targets EphA2 Receptor", J. Biol. Chem., vol. 277(49), pp. 46974-46979 (2002).

Kozlosky, et al., "Lerk-7: A Ligand of the Eph-Related Kinases is Developmentally Regulated in the Brain", Cytokine, vol. 9(8), pp. 540-549 (1997).

Lindberg, et al., "cDna Cloning and Characterization of *eck*, an Epithelial Cell Receptor Protein-Tyrosine Kinase in the *eph/elk* Family of Protein Kinases", Molec. Cell. Biol., vol. 10(12), pp. 6316-6324 (1990).

Lombardo, et al., "Discovery of N-(2-Chloro-6-methyl-phenyl)-2-(6-(4-(2-hydroxyethyl)-piperazin-1-yl)-2-methylpyrimidin-4-ylamino)thiazole-5-carboxamide(BMS-354825), a Dual Src/Abl Kinase Inhibitor with Potent Antitumor Activity in Preclinical Assays", J. Med. Chem., vol. 47, pp. 6658-6661 (2004).

Lu, et al., "EphA2 Overexpression Decreases Estrogen Dependence and Tamoxifen Sensitivity", Cancer Res., vol. 63, pp. 3425-3429 (2003).

Macrae, et al., "A Conditional Feedback Loop Regulates Ras Activity Through EphA2", Cancer Cell, vol. 8, pp. 111-118 (2005).

Miao, et al., "Activation of EphA2 Kinase Suppresses Integrin Function and Causes Focal-Adhesion-Kinase Dephosphorylation", Nature Cell Biol., vol. 2, pp. 62-69 (2000).

Miyazaki, et al., "EphA2 Overexpression Correlates With Poor Prognosis in Esophageal Squamous Cell Carcinoma", Int. J. Cancer, vol. 103, pp. 657-663 (2003).

Nakamoto, et al., "Diverse Roles for the Eph Family of Receptor Tyrosine Kinases in Carcinogenesis", Microscopy Research Tech., vol. 59, pp. 58-67 (2002).

Nakamura, et al., "Epha2/Efna1 Expression in Human Gastric Cancer", Cancer Sci., vol. 96(1), pp. 42-47 (2005).

Ogawa, et al., "The Ephrin-A1 Ligand and its Receptor, EphA2, are Expressed during Tumor Neovascularization", Oncogene, vol. 19, pp. 6043-6052 (2000).

Paik, et al., "A Multigene Assay to Predict Recurrence of Tamoxifen-Treated, Node-Negative Breast Cancer", New Eng. J. Med., vol. 351(27), pp. 2817-2826 (2004).

Pandey, et al., "Characterization of a Novel Src-like Adapter Protein That Associates with the Eck Receptor Tyrosine Kinase", vol. 270(33), pp. 19201-19204 (1995).

Pandey, et. al., "Activation of the Eck Receptor Protein Tyrosine Kinase Stimulates Phosphatidylinositol 3-Kinase Activity", J. Biol. Chem., vol. 269(48), pp. 30154-30157 (1994).

Pandey, et. al., "Role of B61, the Ligand for the Eck Receptor Tyrosine Kinase, in TNF-α-Induced Angiogenesis", Science, vol. 268, pp. 567-569 (1995).

Parri, et. al., "EphrinA1 Repulsive Response is Regulated by an EphA2 Tyrosine Phosphatase", J. Biol. Chem., vol. 280(40), pp. 34008-34018 (2005).

Pratt, et al., "Activation of the EphA2 Tyrosine Kinase Stimulates the MAP/ERK Kinase Signaling Cascade", Oncogene, vol. 21, pp. 7690-7699 (2002).

Riss, et al., "Comparison of MTT, XTT, and Novel Letrazollum Compound MTS for In Vitro Proliferation and Chamosensitivity Assays", Mol. Biol. Cell, 3 (Suppl):184(a).

Ruiz, et al., "The Expression of the Receptor-Protein Tyrosine Kinase Gene, Eck, is Highly Restricted during Early Mouse Development", Mechanisms Develop., vol. 46, pp. 87-100 (1994).

Saito, et al., "Expression of EphA2 and E-Cadeherin in Colorectal Cancer: Correlation with Cancer Metastasis", Oncology Rep., vol. 11, pp. 605-661 (2004).

Sambrook, J. et al., Molecular Cloning: A Laboratory Manual, /First and Second Edition, Book 1, Cold Spring Harbor Laboratory Press, publ., pp. 1.93-1.104 (1989).

Sulman, et al., "ECK, a Human EPH-Related Gene, Maps to 1p36.1, a Common Region of Alteration in Human Cancers", Genomics, vol. 40, pp. 371-374 (1997).

Tanaka, et al., "EphA2 Phosphorylates the Cytoplasmic Tail of Claudin-4 and Mediates Paracellular Permeability", J. Biol. Chem., vol. 280(51), pp. 42375-42382 (2005).

Thaker, et al., "EphA2 Expression is Associated with Aggressive Features in Ovarian Carcinoma", Clin. Cancer Res., vol. 10, pp. 5145-5150 (2004).

Walker-Daniels, et al., "Differential Regulation of EphA2 in Normal and Malignant Cells", Amer. J. Path., vol. 162(4), pp. 1037-1042 (2003).

Walker-Daniels, et al., "C-Cbl-Dependent EphA2 Protein Degradation is Induced by Ligand Binding", Molecular Cancer Res., vol. 1, pp. 79-87 (2002).

Wands, et al., "High Affinity Monoclonal Antibodies to Hepatitis B Surface Antigen ($HB_8Ag$) Produced by Somatic Cell Hybrids", Gastroenterology, vol. 80, pp. 225-232 (1981).

Wang, et al., "Negative Regulation of EphA2 Receptor by Cbl", Biochem. Biophys. Res. Comm., vol. 296, pp. 214-220 (2002).

Wilkonson, D.G., "Eph Receptors and Ephrins: Regulators of Guidance and Assembly", International Rev. Cytology, vol. 196, pp. 177-244 (2000).

Wilkonson, D.G., "Multiple Roles of EPH Receptors and Ephrins in Neural Development", vol. 2, pp. 155-164 (2001).

Xu, et al., "EphA2: Expression in the Renal Medulla and Regulation by Hypertonicity and Urea Stress In Vitro and In Vivo", Am. J. Physiol. Renal Physiol, vol. 288, pp. F855-F866 (2005).

Xu, et al., "Roles of Eph Receptors and Ephrins in Segmental Patterning", Phil. Trans. R. Soc. Lond., B., vol. 355, pp. 993-1002 (2000).

Yong, et al., "Molecular Profiling of CD34+ Cells Identifies Low Expression of CD7, Along with High Expression of Proteinase 3 or Elastase, as Predictors of Longer Survival in Patients with CML", Blood, vol. 107(1), pp. 205-212 (2006).

Zelinski, et al., "Estrogen and Myc Negatively Regulate Expression of the EphA2 Tyrosine Kinase", J. Cell. Biochem., vol. 85, pp. 714-720 (2002).

Zeng, et al., "High-Level Expression of EphA2 Receptor Tyrosine Kinase in Prostatic Intraepithelial Neoplasia", Amer. J. Path., vol. 163(6), pp. 2271-2276 (2003).

Zhou, R., "The Eph Family Receptors and Ligands", Pharmacol. Ther., vol. 77(3), pp. 151-181 (1998).

NCBI Entrez Accession No. NM_004431 (gi:32967310), Hess, et al., Aug. 13, 2006.

"Affimetrix GeneChip Human Genome U133 Array Set HG-U1233A", GEO, Mar. 11, 2002, XP002254749 Probe ID 203499_at, probe ID 212097_at, Probe ID 213426_s_at, probe ID 213503_x_at.

Hofmann, et al., "Relation between resistance of Philadelphia-chromosome-positive acute lymphoblastic leukaemia to the tyrosine kinase inhibitor ST1571 and gene-expression profiles: a gene-expression study", The Lancet, vol. 359, pp. 481-486 (2002).

Carles-Kinch, et al., "Antibody Targeting of the EphA2 Tyrosine Kinase Inhibits Malignant Cell Behavior", Cancer Res., vol. 62, pp. 2840-2847 (2002).

NCBI Entrez Accession No. M59371 (gi:181943), Lindberg, et al., Nov. 21, 1994.

Sixth Annual Conference—Targeted Therapies in the Treatment of Breast Cancer, Jul. 2003; "Development of Src Kinase Inhibitors for the Treatment of Breast Cancer", Arthur P. DeCillis, Group Director, Oncology Clinical Development, Bristol-Myers Squibb Oncology.

Fan, et al., "Concordance among Gene-Expression-Based Predictors for Breast Cancer", N. Engl. J. Med., vol. 355, pp. 560-569 (2006).

Hess, et al., "Pharmacogenomic Predictor of Sensitivity to Preoperative Chemotherapy With Paclitaxel and Fluorouracil, Doxorubicin, and Cyclophosphamide in Breast Cancer", J. Clin. Oncology, vol. 24, pp. 4236-4244 (2006).

Hsu, et al., "Pharmacogenomic Strategies Provide a Rational Approach to the Treatment of Cisplatin-Resistant Patients With Advanced Cancer", J. Clin. Oncology, vol. 25 (28), pp. 4350-4357 (2007).

Laakso, et al., "Basoluminal Carcinoma: A New Biologically and Prognostically Distinct Entity Between Basal and Luminal Breast Cancer", Clin. Cancer Res., vol. 12 (14), pp. 4185-4191 (2006).

Potti, et al., "Genomic signatures to guide the use of chemotherapeutics", Nature Medicine, vol. 12 (11), pp. 1294-1300 (2006).

Rouzier, et al., "Breast Cancer Molecular Subtypes Respond Differently to Preoperative Chemotherapy", Clin. Cancer Res., vol. 11 (16), pp. 5678-5685 (2005).

Sotiriou, et al., "Breast cancer classification and prognosis based on gene expression profiles from a population-based study", PNAS, vol. 100 (18), pp. 10393-10398 (2003).

Thomas, et al., "Association between Keratin and Vimentin Expression, Malignant Phenotype, and Survival in Postmenopausal Breast Cancer Patients", Clin. Cancer Res., vol. 5, pp. 2698-2703 (1999).

\* cited by examiner

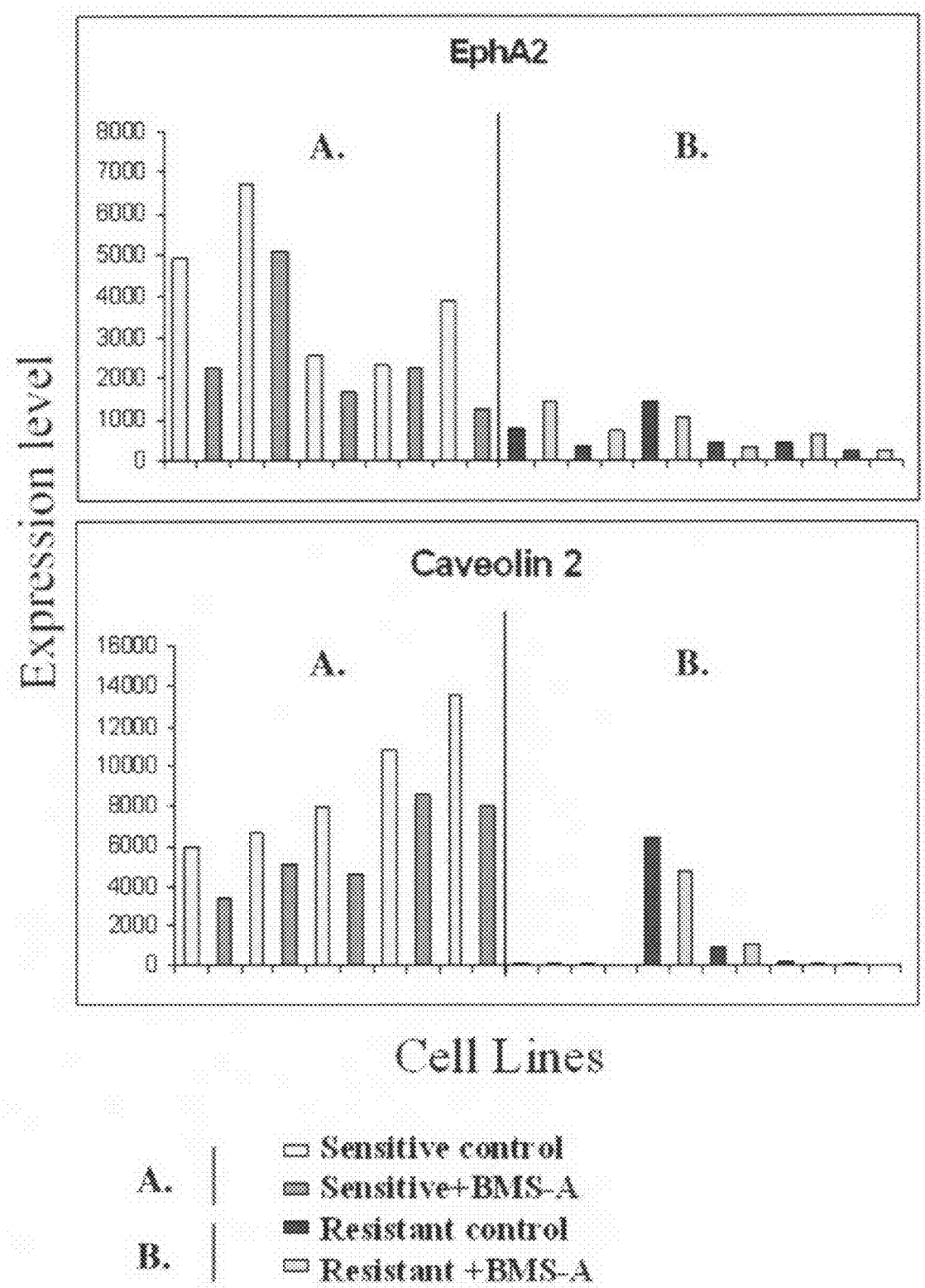

Potential responders

METHODS OF USING EPHA2 FOR PREDICTING ACTIVITY OF COMPOUNDS THAT INTERACT WITH AND/OR MODULATE PROTEIN TYROSINE KINASES AND/OR PROTEIN TYROSINE KINASE PATHWAYS IN BREAST CELLS

This application claims benefit to provisional application U.S. Ser. No. 60/406,385 filed Aug. 27, 2002, under 35 U.S.C. 119(e). The entire teachings of the referenced applications are incorporated herein by reference.

FIELD OF THE INVENTION

The present invention relates generally to the field of pharmacogenomics, and more specifically to new and alternative methods and procedures to determine drug sensitivity in patients, and particularly in patients with breast cancer. This invention allows the development of individualized genetic profiles which aid in treating diseases and disorders based on patient response at a molecular level.

BACKGROUND OF THE INVENTION

Breast cancer is a disease with extensive histoclinical heterogeneity. Although conventional histological and clinical features have been correlated with prognosis, the same apparent prognostic type of breast tumors vary widely in their responsiveness to therapy and consequent survival of the patient. New prognostic and predictive markers are needed to accurately foretell a patient's response to drugs in the clinic. Such markers would facilitate the individualization of therapy for each patient.

The problem may be solved by the identification of new parameters that can better predict a patient's sensitivity to treatment or therapy. The classification of patient samples is a crucial aspect of cancer diagnosis and treatment. The association of a patient's response to drug treatment with molecular and genetic markers can open up new opportunities for drug development in non-responding patients, or distinguish a drug's indication among other treatment choices because of higher confidence in the efficacy. Further, the pre-selection of patients who are likely to respond well to a medicine, drug, or combination therapy may reduce the number of patients needed in a clinical study or accelerate the time needed to complete a clinical development program (M. Cockett et al., 2000, *Current Opinion in Biotechnology*, 11:602-609).

The major goal of pharmacogenomics research is to identify genetic markers that accurately predict a given patient's response to drugs in the clinic; such individualized genetic assessment would greatly facilitate personalized treatment. An approach of this nature is particularly needed in cancer treatment and therapy, where commonly used agents are ineffective in many patients, and side effects are frequent. The ability to predict drug sensitivity in patients is particularly challenging because drug responses reflect both the properties intrinsic to the target cells and also a host's metabolic properties. Efforts by those in the art to use genetic information to predict drug sensitivity have primarily focused on individual polynucleotides that have broad effects, such as the multidrug resistant polynucleotides, mdr1 and mrp1 (P. Sonneveld, 2000, *J. Intern. Med.*, 247:521-534).

The development of microarray technologies for large scale characterization of polynucleotide expression pattern makes it possible to systematically search for multiple molecular markers and to categorize cancers into distinct subgroups that are not evident by traditional histopathological methods (J. Khan et al., 1998, *Cancer Res.*, 58:5009-5013; A. A. Alizadeh et al., 2000, *Nature*, 403:503-511; M. Bittner et al., 2000, *Nature*, 406:536-540; J. Khan et al., 2001, *Nature Medicine*, 7(6):673-679; and T. R. Golub et al., 1999, *Science*, 286:531-537; U. Alon et al., 1999, *Proc. Natl. Acad. Sci. USA*, 96:6745-6750). Such technologies and molecular tools have made it possible to monitor the expression levels of a large number of transcripts within a cell at any given time (see, e.g., Schena et al., 1995, *Science*, 270:467-470; Lockhart et al., 1996, *Nature Biotechnology*, 14:1675-1680; Blanchard et al., 1996, *Nature Biotechnology*, 14:1649; and U.S. Pat. No. 5,569,588, issued Oct. 29, 1996 to Ashby et al.).

How differential polynucleotide expression is associated with health and disease is a basis of functional genomics, which is defined as the study of all of the polynucleotides expressed by a specific cell or a group of cells and the changes in their expression pattern during development, disease, or environmental exposure. Hybridization arrays, used to study polynucleotide expression, allow polynucleotide expression analysis on a genomic scale by permitting the examination of changes in expression of literally thousands of polynucleotides at one time. In general, for hybridization arrays, gene-specific sequences (probes) are immobilized on a solid state matrix. These sequences are then queried with labeled copies of nucleic acids from biological samples (targets). The underlying theory is that the greater the expression of a gene, the greater the amount of labeled target and thus, the greater output of signal. (W. M. Freeman et al., 2000, *BioTechniques*), 29:1042-1055).

Recent studies have demonstrated that polynucleotide expression information generated by microarray analysis of human tumors can predict clinical outcome (L. J. van't Veer et al., 2002, *Nature*, 415:530-536; M. West et al., 2001, *Proc. Natl. Acad. Sci. USA*, 98:11462-11467; T. Sorlie et al., 2001, *Proc. Natl. Acad. Sci. USA*, 98:10869-10874; M. Shipp et al., 2002, *Nature Medicine*, 8(1):68-74). These findings bring hope that cancer treatment will be vastly improved by better predicting the response of individual tumors to therapy.

Needed in the art are new and alternative methods and procedures to determine drug sensitivity in patients and which are necessary to treat diseases and disorders, particularly cancers such as breast cancer, based on patient response at a molecular level. By using cultured cells as a model of in vivo effects, the present invention advantageously focuses on cell-intrinsic properties that are exposed in cell culture and involves identified polynucleotides that correlate with drug sensitivity. The presently described discovery and identification of polynucleotides/marker polynucleotides (predictor polynucleotides and polynucleotide sets) in cell lines assayed in vitro can be used to correlate with drug responses in vivo, and thus can be extended to clinical situations in which the same polynucleotides are used to predict responses to drugs and/or chemotherapeutic agents by patients, with particular regard to breast cancer patients.

SUMMARY OF THE INVENTION

The present invention describes the identification of marker polynucleotides whose expression levels are highly correlated with drug sensitivity in breast cell lines that are either sensitive or resistant to protein tyrosine kinase inhibitor compounds. More particularly, the protein tyrosine kinases that are inhibited in accordance with the present invention include members of the Src family of tyrosine kinases, for example, Src, Fgr, Fyn, Yes, Blk, Hck, Lck and Lyn, as well as other protein tyrosine kinases, including, Bcr-abl, Jak, PDGFR, c-kit and Eph receptors. For a review of these and other protein tyrosine kinases, see, for example, P. Blume-Jensen and T. Hunter, 2001, "Oncopolynucleotide Kinase Signaling", *Nature*, 411:355-365. Some of these polynucleotides are also modulated by the tyrosine kinase inhibitor compounds, in particular, src tyrosine kinase inhibitor compounds, which indicates their involvement in the protein tyrosine kinase signaling pathway. These polynucleotides or "markers" show utility in predicting a host's response to a drug and/or drug treatment. Similar expression pattern of these polynucleotides to breast cell lines is also seen in primary breast tumors which indicates co-regulation of these marker polynucleotides.

It is an aspect of this invention to provide a cell culture model to identify polynucleotides whose expression levels correlate with drug sensitivity of cells associated with a disease state, or with a host having a disease. In accordance with the present invention, oligonucleotide microarrays were utilized to measure the expression levels of a large number of polynucleotides in a panel of untreated cell lines, particularly breast cell lines, for which drug sensitivity to a protein tyrosine kinase inhibitor compound was determined. The determination of the polynucleotide expression profiles in the untreated cells allowed a prediction of chemosensitivity and the identification of marker polynucleotides whose expression levels highly correlated with sensitivity to drugs or compounds that modulate, preferably inhibit, protein tyrosine kinase or the pathway in which the protein tyrosine kinase, e.g., src tyrosine kinase, is involved. The marker polynucleotides are thus able to be utilized as one or more predictors to foresee a patient's response to drugs or drug treatments that directly or indirectly affect protein tyrosine kinase activity.

It is another aspect of the present invention to provide a method of determining or predicting if an individual requiring drug or chemotherapeutic treatment or therapy for a disease state, or a cancer or tumor of a particular type, e.g., a breast cancer or breast tumor, will successfully respond or will not respond to the drug or chemotherapeutic treatment or therapy prior to the administration of such treatment or chemotherapy. Preferably, the treatment or therapy involves a protein tyrosine kinase modulating agent, e.g., an inhibitor of the protein tyrosine kinase activity. The protein tyrosine kinases whose activities can be inhibited by inhibitor compounds according to this invention include, for example, members of the Src family of tyrosine kinases, for example, Src, Fgr, Fyn, Yes, Blk, Hck, Lck and Lyn, as well as other protein tyrosine kinases, including, Bcr-abl, Jak, PDGFR, c-kit and Eph receptors. Also in accordance with the present invention, cells from a patient tissue sample, e.g., a breast tumor or cancer biopsy, are assayed to determine their polynucleotide expression pattern prior to treatment with a protein tyrosine kinase modulating compound or drug, preferably a src tyrosine kinase inhibitor. The resulting polynucleotide expression profile of the test cells before exposure to the compound or drug is compared with the polynucleotide expression pattern of the predictor set of polynucleotides that have been described and shown herein (Table 2). In addition, in such a method, the polynucleotide expression pattern of subsets of predictor polynucleotides, i.e., the sets of 15 and 7 polynucleotides as set forth in Tables 4-5, respectively, can also be used. These polynucleotides are derived from the control panel of the untreated cells that have been determined to be either resistant or sensitive to the drug or compound, i.e., FIG. 1 and Table 1.

Success or failure of treatment with a drug can be determined based on the polynucleotide expression pattern of cells from the test tissue (test cells), e.g., a tumor or cancer biopsy, as being relatively similar to or different from the polynucleotide expression pattern of the predictor set of polynucleotides. Thus, if the test cells show a polynucleotide expression profile which corresponds to that of the predictor set of polynucleotides in the control panel of cells which are sensitive to the drug or compound, it is highly likely or predicted that the individual's cancer or tumor will respond favorably to treatment with the drug or compound. By contrast, if the test cells show a polynucleotide expression pattern corresponding to that of the predictor set of polynucleotides of the control panel of cells which are resistant to the drug or compound, it is highly likely or predicted that the individual's cancer or tumor will not respond to treatment with the drug or compound.

It is a further aspect of this invention to provide screening assays for determining if a cancer patient will be susceptible or resistant to treatment with a drug or compound, particularly, a drug or compound directly or indirectly involved in a protein tyrosine kinase activity or a protein tyrosine kinase pathway. Such protein tyrosine kinases include, without limitation, members of the Src family of tyrosine kinases, for example, Src, Fgr, Fyn, Yes, Blk, Hck, Lck and Lyn, as well as other protein tyrosine kinases, including, Bcr-abl, Jak, PDGFR, c-kit and Eph receptors.

In a more particular aspect, the present invention provides screening assays for determining if a cancer patient will be susceptible or resistant to treatment with a drug or compound, particularly, a drug or compound directly or indirectly involved in src tyrosine kinase activity or the src tyrosine kinase pathway.

It is another aspect of the present invention to provide a method of monitoring the treatment of a patient having a disease treatable by a compound or agent that modulates a protein tyrosine kinase, including members of the Src family of tyrosine kinases, for example, Src, Fgr, Fyn, Yes, Blk, Hck, Lck and Lyn, as well as other protein tyrosine kinases, including, Bcr-abl, Jak, PDGFR, c-kit and Eph receptors. This can be accomplished by comparing the resistance or sensitivity polynucleotide expression profile of cells from a patient tissue sample, e.g., a tumor or cancer biopsy, e.g., a breast cancer or tumor sample, prior to treatment with a drug or compound that inhibits the protein tyrosine kinase activity and again following treatment with the drug or compound. The isolated test cells from the patient's tissue sample are assayed to determine their polynucleotide expression pattern before and after exposure to a compound or drug, such as, e.g., a src tyrosine kinase inhibitor. The resulting polynucleotide expression profile of the test cells before and after treatment is compared with the polynucleotide expression pattern of the predictor set and subsets of polynucleotides that have been described and shown herein to be highly expressed in the control panel of cells that are either resistant or sensitive to the drug or compound. Thus, if a patient's response becomes one that is sensitive to treatment by a protein tyrosine kinase inhibitor compound, based on a correlation of the expression profile of the predictor polynucleotides, the patient's treatment prognosis can be qualified as favorable and treatment can continue. Also, if after treatment with a drug or compound, the test cells do not show a change in their polynucleotide expression profile that corresponds to the control panel of cells that are sensitive to the drug or compound, this can serve as an indicator that the current treatment should be modified, changed, or even discontinued. Such a monitoring process can indicate success or failure of a patient's treatment with a drug or compound, and the monitoring processes can be repeated as necessary or desired.

It is a further aspect of the present invention to provide predictor polynucleotides and predictor sets of polynucleotides having both diagnostic and prognostic value in disease areas in which signaling through a protein tyrosine kinase or a protein tyrosine kinase pathway is of importance, e.g., in cancers and tumors, in immunological disorders, conditions or dysfunctions, or in disease states in which cell signaling and/or proliferation controls are abnormal or aberrant. Such protein tyrosine kinases whose direct or indirect modulation can be associated with a disease state or condition, include members of the Src family of tyrosine kinases, for example, Src, Fgr, Fyn, Yes, Blk, Hck, Lck and Lyn, as well as other protein tyrosine kinases, including, Bcr-abl, Jak, PDGFR, c-kit and Eph receptors. In accordance with this invention, the use of predictor polynucleotides, or a predictor polynucleotide set or subset (such as the predictor polynucleotides of Table 2, and the predictor polynucleotide subsets of Tables 4-5) is to forecast or foretell an outcome prior to having any knowledge about a biological system, or a cellular response.

It is yet another aspect of the present invention to assemble polynucleotides, such as those listed in Table 2, or the subset of polynucleotides as listed in Tables 4-5, that highly correlate with resistance or sensitivity to protein tyrosine kinase inhibitor drugs or compounds, into predictor polynucleotide sets, so as to predict, or reasonably foretell the effect of either the protein tyrosine inhibitor compounds, or compounds that affect the protein tyrosine kinase signaling pathway(s) in different biological systems, or for cellular responses. The predictor polynucleotide sets can be used in in vitro assays of drug response by test cells to predict in vivo outcome. In accordance with this invention, the various predictor polynucleotide sets described herein, or the combination of these predictor sets with other polynucleotides or other co-variants of these polynucleotides, can be used, for example, to predict how patients with cancer or a tumor might respond to therapeutic intervention with compounds that modulate protein tyrosine kinases, or modulate signaling through an entire protein tyrosine kinase regulatory pathway. The predictor sets of polynucleotides, or co-variants of these polynucleotides, can be used to predict how patients with a cancer or tumor respond to therapy employing compounds that modulate a tyrosine kinase, or the activity of a tyrosine kinase, such as protein tyrosine kinase members of the Src family, for example, Src, Fgr, Fyn, Yes, Blk, Hck, Lck and Lyn, as well as other protein tyrosine kinases, including, Bcr-abl, Jak, PDGFR, c-kit and Eph receptors.

Another object of the present invention is to provide one or more specialized microarrays, e.g., oligonucleotide microarrays or cDNA microarrays, comprising those polynucleotides or combinations thereof, as described herein, showing expression profiles that correlate with either sensitivity or resistance to protein tyrosine kinase inhibitor compounds. Such microarrays can be employed in in vitro assays for assessing the expression level of the polynucleotides on the microarrays in the test cells from tumor biopsies, for example, and determining whether these test cells will be likely to be resistant or sensitive to the protein tyrosine kinase inhibitor compound(s). For example, a specialized microarray can be prepared using some or all of the polynucleotides, polynucleotide subsets, or combinations thereof, as described herein and shown in Tables 2, 4 and 5. Cells from a tissue or organ biopsy can be isolated and exposed to one or more inhibitor compounds. Following application of nucleic acids isolated from both untreated and treated cells to one or more of the specialized microarrays, the pattern of polynucleotide expression of the tested cells can be determined and compared with that of the predictor polynucleotide pattern from the control panel of cells used to create the predictor polynucleotide set on the microarray. Based upon the polynucleotide expression pattern results from the cells undergoing testing, it can be determined if the cells show a resistant or a sensitive profile of polynucleotide expression. Whether or not the tested cells from a tissue or organ biopsy will respond to a protein tyrosine kinase inhibitor compound, and the course of treatment or therapy, can then be determined or evaluated based on the information gleaned from the results of the specialized microarray analysis.

It is a further aspect of the present invention to provide a kit for determining or predicting drug susceptibility or resistance by a patient having a disease, with particular regard to a cancer or tumor, namely, a breast cancer or tumor. Such kits are useful in a clinical setting for testing a patient's biopsied tumor or cancer sample, for example, to determine or predict if the patient's tumor or cancer will be resistant or sensitive to a given treatment or therapy with a drug, compound, chemotherapy agent, or biological agent that is directly or indirectly involved with modification, preferably, inhibition, of the activity of a protein tyrosine kinase or a cell signaling pathway involving protein tyrosine kinase activity. Provided in the kit are one or more microarrays, e.g., oligonucleotide microarrays or cDNA microarrays, comprising those polynucleotides that correlate with resistance and sensitivity to protein tyrosine kinase modulators, particularly, inhibitors of members of the Src family of protein tyrosine kinases, for example, Src, Fgr, Fyn, Yes, Blk, Hck, Lck and Lyn, as well as inhibitors of the Bcr-abl, Jak, PDGFR, c-kit and Eph receptors protein tyrosine kinases; and, in suitable containers, the modulator agents/compounds for use in testing cells from patient tissue specimens or patient samples; and instructions for use. In addition, kits contemplated by the present invention can include reagents or materials for the monitoring of the expression of the predictor or marker polynucleotides of the invention at the level of mRNA or protein, using other techniques and systems practiced in the art, e.g., RT-PCR assays, which employ primers designed on the basis of one or more of the predictor polynucleotides described herein, immunoassays, such as enzyme linked immunosorbent assays (ELISAs), immunoblotting, e.g., Western blots, or in situ hybridization, and the like, as further described herein. The kits according to the present invention can also comprise predictor polynucleotides as set forth in Table 2, and/or one or more of the predictor polynucleotide subsets as presented in Tables 4-5 herein.

Another aspect of the present invention is to provide one or more polynucleotides among those of the predictor polynucleotides identified herein that can serve as targets for the development of drug therapies for disease treatment. Such targets can be particularly applicable to treatment of breast disease, such as breast cancers or tumors. Because these predictor polynucleotides are differentially expressed in sensitive and resistant cells, their expression pattern is correlated with the relative intrinsic sensitivity of cells to treatment with compounds that interact with and/or inhibit protein tyrosine kinases, including members of the Src family of protein tyrosine kinases, for example, Src, Fgr, Fyn, Yes, Blk, Hck, Lck and Lyn, as well as the Bcr-abl, Jak, PDGFR, c-kit and Eph receptors protein tyrosine kinases. Accordingly, the polynucleotides highly expressed in resistant cells can serve as targets for the development of new drug therapies for those tumors which are resistant to protein tyrosine kinase inhibitor compounds.

Yet another object of the present invention is to provide antibodies, either polyclonal or monoclonal, directed against one or more of the protein tyrosine kinase biomarker polypeptides, or peptides thereof, encoded by the predictor polynucleotides. Such antibodies can be used in a variety of ways, for example, to purify, detect, and target the protein tyrosine kinase biomarker polypeptides of the present invention, including both in vitro and in vivo diagnostic, detection, screening, and/or therapeutic methods, and the like. Included among the protein tyrosine kinase biomarker polypeptides of this invention are members of the Src family of protein tyrosine kinases, for example, Src, Fgr, Fyn, Yes, Blk, Hck, Lck and Lyn, as well as the Bcr-abl, Jak, PDGFR, c-kit and Eph receptors protein tyrosine kinases.

Yet another object of the present invention is to provide antisense reagents, including siRNA, RNAi, and ribozyme reagents, directed against one or more of the protein tyrosine kinase biomarker polypeptides, or peptides thereof, encoded by the predictor polynucleotides. Such antisense reagents can be used in a variety of ways, for example, to detect, to target, and inhibit the expression of the protein tyrosine kinase biomarker polypeptides of the present invention, including both in vitro and in vivo diagnostic, detection, screening, and/or therapeutic methods, and the like. Included among the protein tyrosine kinase biomarker polypeptides of this invention are members of the Src family of protein tyrosine kinases, for example, Src, Fgr, Fyn, Yes, Blk, Hck, Lck and Lyn, as well as the Bcr-abl, Jak, PDGFR, c-kit and Eph receptors protein tyrosine kinases.

The invention also relates to an antisense compound 8 to 30 nucleotides in length that specifically hybridizes to a nucleic acid molecule encoding the human protein tyrosine kinase biomarker polypeptides of the present invention, wherein said antisense compound inhibits the expression of the human protein tyrosine kinase biomarker polypeptides.

The invention further relates to a method of inhibiting the expression of the human protein tyrosine kinase biomarker polypeptides of the present invention in human cells or tissues comprising contacting said cells or tissues in vitro, or in vivo, with an antisense compound of the present invention so that expression of the protein tyrosine kinase biomarker polypeptides is inhibited.

The present invention is also directed to a method of identifying a compound that modulates the biological activity of protein tyrosine kinase biomarker polypeptides, comprising the steps of, (a) combining a candidate modulator compound with protein tyrosine kinase biomarker polypeptides in the presence of an antisense molecule that antagonizes the activity of the protein tyrosine kinase biomarker polypeptides selected from the group consisting of SEQ ID NO:534 thru 557, and (b) identifying candidate compounds that reverse the antagonizing effect of the peptide.

The present invention is also directed to a method of identifying a compound that modulates the biological activity of protein tyrosine kinase biomarker polypeptides, comprising the steps of, (a) combining a candidate modulator compound with protein tyrosine kinase biomarker polypeptides in the presence of a small molecule that antagonizes the activity of the protein tyrosine kinase biomarker polypeptides selected from the group consisting of SEQ ID NO:534 thru 557, and (b) identifying candidate compounds that reverse the antagonizing effect of the peptide.

The present invention is also directed to a method of identifying a compound that modulates the biological activity of protein tyrosine kinase biomarker polypeptides, comprising the steps of, (a) combining a candidate modulator compound with protein tyrosine kinase biomarker polypeptides in the presence of a small molecule that agonizes the activity of the protein tyrosine kinase biomarker polypeptides selected from the group consisting of SEQ ID NO:534 thru 557, and (b) identifying candidate compounds that reverse the agonizing effect of the peptide.

Further aspects, features, and advantages of the present invention will be better appreciated upon a reading of the detailed description of the invention when considered in connection with the accompanying figures or drawings.

DESCRIPTION OF THE FIGURES

The file of this patent contains at least one Figure executed in color. Copies of this patent with color Figure(s) will be provided by the Patent and Trademark Office upon request and payment of the necessary fee.

FIG. 5 demonstrates that a different selection and different combination of polynucleotides in a predictor set achieve different error rates in the leave-one-out cross validation. When the predictor sets were selected from 137 polynucleotides as shown in Table 2, the lowest error rate of 6.3% was achieved in the leave-one-out cross validation with 15 markers. Another predictor set comprised of 7 polynucleotides selected from the 40 polynucleotides that were modulated by the drug treatment achieved an error rate of 3.1%. These results indicate that polynucleotides which are not only correlated with drug sensitivity, but also modulated by the drug, can provide a better and more accurate prediction in a predictor set.

DESCRIPTION OF THE TABLES

Figure 1:
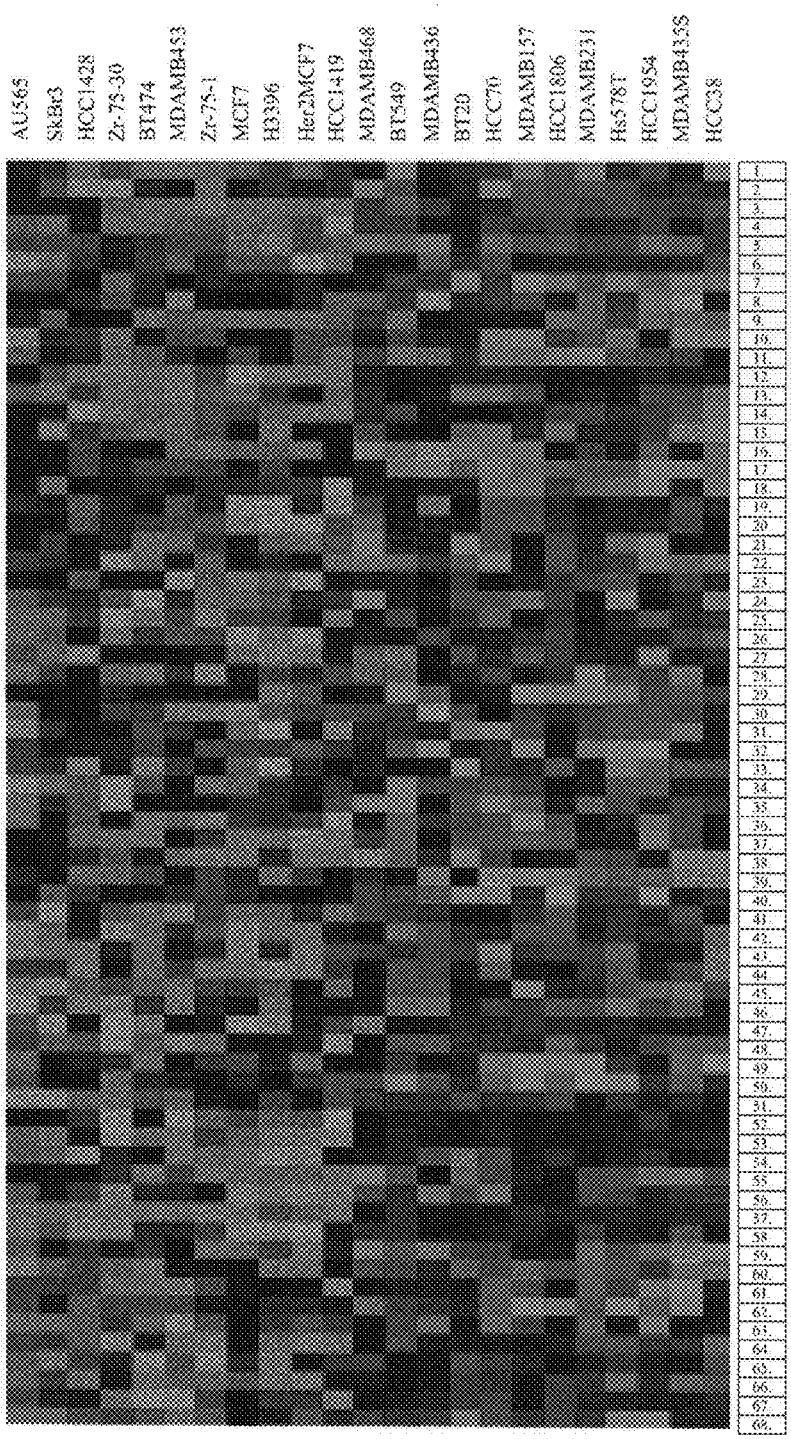
FIG. 1 illustrates a polynucleotide expression pattern according to the present invention. The 137 polynucleotides that highly correlated with a resistance/sensitivity phenotype classification of the 23 breast cell lines for the protein tyrosine kinase inhibitor compound BMS-A are shown. Each row corresponds to a polynucleotide, with the columns corresponding to expression level in the different cell lines. Expression levels for each polynucleotide were normalized across all 23 breast cell lines such that the median is 0 and the standard derivation is 1. The expression levels greater than the median are shaded in red, those below the mean are shaded in green, while those at the mean are shaded in black. The individual polynucleotides encoding the protein tyrosine kinase biomarkers of the invention are indicated at the right (details of the biomarkers are also shown in the Table 2). The cell lines have been classified as being sensitive or resistant to BMS-A according to their $IC_{50}$ as provided in Table 1.

Table 1 presents the resistance/sensitivity phenotype classification of the 23 breast cell lines for the protein tyrosine kinase inhibitor compound BMS-A based on $IC_{50}$ results. The $IC_{50}$ for each cell line was assessed in by MTS assays as described in Example 1 (Methods). The mean $IC_{50}$ values along with standard deviations (SD) were calculated from 2 to 5 individual determinations for each cell line as shown. The $IC_{50}$ unit is µM. The mean $IC_{50}$ for each cell line was log-transformed to $\log_{10}(IC_{50})$ and the mean $\log_{10}(IC_{50})$ across the 23 breast cell lines for BMS-A was calculated and used to normalize the $IC_{50}$ data for each cell line. The cell lines with a $\log_{10}(IC_{50})$ below the mean $\log_{10}(IC_{50})$ were defined as sensitive to the compound, while those having a $\log_{10}(IC_{50})$ above the mean $\log_{10}(IC_{50})$ were considered to be resistant. The cell lines presented in bold were used in the drug induction study as described herein.

TABLE 1

| # | Cell Lines | mean $IC_{50}$ (µM) to BMS-A | SD | $Log(IC_{50})$ | Normalized $Log(IC_{50})$ | Classification |
|---|---|---|---|---|---|---|
| 1 | MDA-MB-157 | 0.0055 | 0.0035 | −2.25924 | −2.25405 | Sensitive |
| 2 | MDA-MB-231 | 0.0095 | 0.0058 | −2.02422 | −2.03843 | Sensitive |
| 3 | HCC1954 | 0.0242 | 0.0172 | −1.61621 | −1.66411 | Sensitive |
| 4 | HCC70 | 0.0337 | 0.0160 | −1.47214 | −1.53193 | Sensitive |
| 5 | BT-20 | 0.1652 | 0.1036 | −0.78195 | −0.89871 | Sensitive |
| 6 | HCC1806 | 0.2194 | 0.1508 | −0.65884 | −0.78576 | Sensitive |
| 7 | HS578T | 0.6472 | 0.5885 | −0.18898 | −0.35469 | Sensitive |
| 8 | HCC1419 | 2.5093 | 0.2280 | 0.399548 | 0.18525 | Resistant |
| 9 | SK-BR-3 | 2.7534 | 0.8410 | 0.439867 | 0.22224 | Resistant |
| 10 | AU-565 | 5.2399 | 3.2627 | 0.719322 | 0.47863 | Resistant |
| 11 | HCC38 | 6.6327 | 3.1673 | 0.821688 | 0.57254 | Resistant |
| 12 | BT-474 | 6.7375 | 4.1515 | 0.828502 | 0.57880 | Resistant |
| 13 | MDA-MB-468 | 7.1258 | 4.0960 | 0.852833 | 0.60112 | Resistant |
| 14 | HCC1428 | 7.2926 | 4.1436 | 0.862881 | 0.61034 | Resistant |
| 15 | MDA-MB-435S | 7.7800 | 2.3643 | 0.89098 | 0.63612 | Resistant |
| 16 | H3396 | 8.1950 | 3.2549 | 0.91355 | 0.65682 | Resistant |
| 17 | BT-549 | 9.0576 | 1.1419 | 0.957014 | 0.69670 | Resistant |
| 18 | ZR-75-30 | 9.2632 | 0.5827 | 0.966762 | 0.70564 | Resistant |
| 19 | MCF7 | >9.5238 | 1.95E−07 | 0.978811 | 0.71670 | Resistant |
| 20 | MCF7/Her2 | >9.5238 | 1.8E−07 | 0.978811 | 0.71670 | Resistant |
| 21 | MDA-MB-436 | >9.5238 | 1.51E−07 | 0.978811 | 0.71670 | Resistant |
| 22 | ZR-75-1 | >9.5238 | 1.8E−07 | 0.978811 | 0.71670 | Resistant |
| 23 | MDA-MB-453 | >9.5238 | | 0.978811 | 0.71670 | Resistant |
| | Mean $IC_{50}$ across all 23 cell lines | 5.2744 | | 0.197626 | | |
| | SD | 3.9565 | | 1.08998 | | |

Table 2 shows a polynucleotide list derived from three analysis algorithms that demonstrated a high correlation between expression pattern and resistance/sensitivity classification to BMS-A. The polynucleotide number, relative expression pattern, i.e., sensitive or resistant, Genbank Accession number, polynucleotide description, Unigene cluster number, SEQ ID NO: for the nucleic acid sequence of the gene, SEQ ID NO: for the amino acid sequence coded for by the polynucleotide (if available) and PID (protein ID), are presented in Table 2. For each gene, the DNA and encoded amino acid sequence represented by SEQ ID NOs. in Table 2 are set forth in the Sequence Listing.

TABLE 2

Markers highly correlated to BMS-A in expression pattern and resistance/sensitivity classification

| Gene No. | Highly Expressed in | Genbank Accession # | Modulated by BMS-A | Unigene Title | Unigene Cluster | DNA SEQ ID NO: | Amino Acid SEQ ID NO: | Protein ID |
|---|---|---|---|---|---|---|---|---|
| 1 | Sensitive cells | NM_004431 | yes | EphA2 | Hs.171596 | 1 | 138 | NP_004422 |
| 2 | Sensitive cells | AF025304 | | EphB2 | Hs.125124 | 2 | 139 | AAB94602 |
| 3 | Sensitive cells | AU147399 | yes | caveolin 1, caveolae protein, 22 kD | Hs.74034 | 3 | 140 | NP_001744 |
| 4 | Sensitive cells | NM_001233 | yes | caveolin 2 | Hs.139851 | 4 | 141 | NP_001224 |
| 5 | Sensitive cells | NM_000700 | yes | annexin A1 | Hs.78225 | 5 | 142 | NP_000691 |
| 6 | Sensitive cells | NM_004039 | | annexin A2 | Hs.406239 | 6 | 143 | NP_004030 |
| 7 | Sensitive cells | BG107577 | | parvin, alpha | Hs.44077 | 7 | 144 | Q9NVD7 |
| 8 | Sensitive cells | BE965369 | yes | coagulation factor II (thrombin) receptor-like 1 | Hs.154299 | 8 | 145 | XP_003671 |
| 9 | Sensitive cells | NM_001993 | yes | coagulation factor III (thromboplastin, tissue factor) | Hs.62192 | 9 | 146 | NP_001984 |
| 10 | Sensitive cells | BF792126 | | Homo sapiens, clone IMAGE: 4344858, mRNA | Hs.432974 | 10 | 147 | P1_453619 |
| 11 | Sensitive cells | BE856341 | | layilin | Hs.133015 | 11 | 148 | Q96NF3 |
| 12 | Sensitive cells | U17496 | | proteasome (prosome, macropain) subunit, beta type, 8 (large multifunctional protease 7) | Hs.180062 | 12 | 149 | P28062 |
| 13 | Sensitive cells | NM_002800 | | proteasome (prosome, macropain) subunit, beta type, 9 (large multifunctional protease 2) | Hs.381081 | 13 | 150 | NP_002791 |
| 14 | Sensitive cells | NM_000311 | | prion protein (p27-30) (Creutzfeld-Jakob disease, Gerstmann-Strausler-Scheinker syndrome, fatal familial insomnia) | Hs.74621 | 14 | 151 | P04156 |
| 15 | Sensitive cells | NM_003739 | yes | aldo-keto reductase family 1, member C3 (3-alpha hydroxysteroid dehydrogenase, type II) | Hs.78183 | 15 | 152 | NP_003730 |
| 16 | Sensitive cells | NM_020639 | | ankyrin repeat domain 3 | Hs.55565 | 16 | 153 | NP_065690 |
| 17 | Sensitive cells | AF208043 | yes | interferon, gamma-inducible protein 16 | Hs.155530 | 17 | 154 | Q16666 |
| 18 | Sensitive cells | AF003837 | yes | jagged 1 (Alagille syndrome) | Hs.91143 | 18 | 155 | P78504 |
| 19 | Sensitive cells | BC002832 | yes | butyrophilin, subfamily 3, member A2 | Hs.87497 | 19 | 156 | AAF76140 |
| 20 | Sensitive cells | NM_006994 | yes | butyrophilin, subfamily 3, member A3 | Hs.167741 | 20 | 157 | NP_008925 |
| 21 | Sensitive cells | AF327443 | | calpastatin | Hs.359682 | 21 | 158 | XP_051211 |
| 22 | Sensitive cells | NM_021615 | yes | carbohydrate (N-acetylglucosamine 6-O) sulfotransferase 6 | Hs.157439 | 22 | 159 | NP_067628 |
| 23 | Sensitive cells | AF104857 | yes | CDC42 effector protein (Rho GTPase binding) 3 | Hs.260024 | 23 | 160 | NP_006440 |
| 24 | Sensitive cells | AL136896 | | suppressor of cytokine signaling 5 | Hs.169836 | 24 | 161 | O75159 |
| 25 | Sensitive cells | AL565621 | yes | coactosin-like protein | Hs.289092 | 25 | 162 | AAH16702 |
| 26 | Sensitive cells | BF111719 | | alkylglycerone phosphate synthase | Hs.22580 | 26 | 163 | O00116 |
| 27 | Sensitive cells | N36770 | | dual specificity phosphatase 10 | Hs.177534 | 27 | 164 | NP_009138 |
| 28 | Sensitive cells | AW575374 | yes | ELK3, ETS-domain protein (SRF accessory protein 2) | Hs.288555 | 28 | 165 | NP_005221 |
| 29 | Sensitive cells | AW269335 | yes | endothelial differentiation, lysophosphatidic acid G-protein-coupled receptor, 2 | Hs.75794 | 29 | 166 | NP_001392 |
| 30 | Sensitive cells | BC001247 | yes | epithelial protein lost in neoplasm beta | Hs.10706 | 30 | 167 | Q9UHB6 |
| 31 | Sensitive cells | BE669858 | | hypothetical protein FLJ39885 | Hs.319825 | 31 | 168 | NP_689916 |
| 32 | Sensitive cells | NM_000127 | | exostoses (multiple) 1 | Hs.184161 | 32 | 169 | NP_000118 |
| 33 | Sensitive cells | NM_002589 | | BH-protocadherin (brain-heart) | Hs.34073 | 33 | 170 | O60245 |
| 34 | Sensitive cells | AI133452 | | fibrinogen, gamma polypeptide | Hs.75431 | 34 | 171 | AAH21674 |
| 35 | Sensitive cells | NM_006101 | | highly expressed in cancer, rich in leucine heptad repeats | Hs.58169 | 35 | 172 | NP_006092 |
| 36 | Sensitive cells | AL135264 | | ESTs, Moderately similar to hypothetical protein FLJ20489 | Hs.406100 | 36 | | |
| 37 | Sensitive cells | NM_014164 | | FXYD domain-containing ion transport regulator 5 | Hs.333418 | 37 | 173 | NP_054883 |
| 38 | Sensitive cells | BC003502 | | small fragment nuclease | Hs.7527 | 38 | 174 | Q9Y3B8 |
| 39 | Sensitive cells | AA780067 | | heparan sulfate (glucosamine) 3-O-sulfotransferase 3B1 | Hs.159572 | 39 | 175 | Q9Y662 |
| 40 | Sensitive cells | AA702248 | yes | Homo sapiens cDNA FLJ14241 fis, clone OVARC1000533 | Hs.183765 | 40 | | |
| 41 | Sensitive cells | BC004372 | | CD44 antigen (homing function and Indian blood group system) | Hs.169610 | 41 | 176 | Q9UJ36 |

TABLE 2-continued

Markers highly correlated to BMS-A in expression pattern and resistance/sensitivity classification

| Gene No. | Highly Expressed in | Genbank Accession # | Modulated by BMS-A | Unigene Title | Unigene Cluster | DNA SEQ ID NO: | Amino Acid SEQ ID NO: | Protein ID |
|---|---|---|---|---|---|---|---|---|
| 42 | Sensitive cells | BF688144 | | Homo sapiens mRNA; cDNA DKFZp762O2215 (from clone DKFZp762O2215) | Hs.331666 | 42 | | |
| 43 | Sensitive cells | NM_018067 | | hypothetical protein FLJ10350 | Hs.177596 | 43 | 177 | NP_060537 |
| 44 | Sensitive cells | BG111761 | | guanine nucleotide binding protein (G protein), gamma 12 | Hs.8107 | 44 | 178 | Q9UBI6 |
| 45 | Sensitive cells | NM_017821 | | nucleoredoxin | Hs.374534 | 45 | 179 | NP_060291 |
| 46 | Sensitive cells | AA722799 | | endothelial and smooth muscle cell-derived neuropilin-like protein | Hs.173374 | 46 | 180 | Q96PD2 |
| 47 | Sensitive cells | BC006436 | | hypothetical protein MGC13105 | Hs.22744 | 47 | 181 | AAH06436 |
| 48 | Sensitive cells | NM_006548 | yes | IGF-II mRNA-binding protein 2 | Hs.30299 | 48 | 182 | NP_006539 |
| 49 | Sensitive cells | NM_002194 | | inositol polyphosphate-1-phosphatase | Hs.32309 | 49 | 183 | NP_002185 |
| 50 | Sensitive cells | BG251556 | | KIAA1949 protein | Hs.101150 | 50 | 184 | BAB85535 |
| 51 | Sensitive cells | J03202 | | laminin, gamma 1 (formerly LAMB2) | Hs.432855 | 51 | 185 | NP_002284 |
| 52 | Sensitive cells | NM_000245 | yes | met proto-oncogene (hepatocyte growth factor receptor) | Hs.316752 | 52 | 186 | NP_000236 |
| 53 | Sensitive cells | NM_002444 | | moesin | Hs.170328 | 53 | 187 | NP_002435 |
| 54 | Sensitive cells | NM_012334 | yes | myosin X | Hs.61638 | 54 | 188 | NP_036466 |
| 55 | Sensitive cells | AI769569 | | ESTs | Hs.112472 | 55 | | |
| 56 | Sensitive cells | NM_002633 | yes | phosphoglucomutase 1 | Hs.1869 | 56 | 189 | NP_002624 |
| 57 | Sensitive cells | BC004295 | yes | polymerase I and transcript release factor | Hs.29759 | 57 | 190 | O00535 |
| 58 | Sensitive cells | NM_016205 | | platelet derived growth factor C | Hs.43080 | 58 | 191 | Q9UL22 |
| 59 | Sensitive cells | NM_004815 | yes | PTPL1-associated RhoGAP 1 | Hs.70983 | 59 | 192 | NP_004806 |
| 60 | Sensitive cells | NM_002872 | | ras-related C3 botulinum toxin substrate 2 (rho family, small GTP binding protein Rac2) | Hs.301175 | 60 | 193 | NP_002863 |
| 61 | Sensitive cells | AF329267 | | SH3-domain kinase binding protein 1 | Hs.153260 | 61 | 194 | XP_039010 |
| 62 | Sensitive cells | AI572079 | | snail homolog 2 (Drosophila) | Hs.93005 | 62 | 195 | AAH14890 |
| 63 | Sensitive cells | NM_001549 | | interferon-induced protein with tetratricopeptide repeats 4 | Hs.181874 | 63 | 196 | O14879 |
| 64 | Sensitive cells | D50683 | | transforming growth factor, beta receptor II (70-80 kD) | Hs.82028 | 64 | 197 | NP_003233 |
| 65 | Sensitive cells | NM_005902 | | MAD (mothers against decapentaplegic, Drosophila) homolog 3 | Hs.288261 | 65 | 198 | Q92940 |
| 66 | Sensitive cells | NM_014452 | | tumor necrosis factor receptor superfamily, member 21 | Hs.159651 | 66 | 199 | NP_055267 |
| 67 | Sensitive cells | AB017644 | | ubiquitin-conjugating enzyme E2E 3 (homologous to yeast UBC4/5) | Hs.4890 | 67 | 200 | XP_096160 |
| 68 | Sensitive cells | BC002323 | | zyxin | Hs.75873 | 68 | 201 | Q15942 |
| 69 | Resistant cells | AL157452 | | Homo sapiens mRNA; cDNA DKFZp761C1712 (from clone DKFZp761C1712) | Hs.4774 | 69 | | |
| 70 | Resistant cells | BF752277 | | hypothetical protein FLJ20151 | Hs.279916 | 70 | 202 | Q9NXM9 |
| 71 | Resistant cells | BF512299 | | ESTs | Hs.438672 | 71 | | |
| 72 | Resistant cells | AL049381 | yes | Homo sapiens mRNA; cDNA DKFZp586J2118 (from clone DKFZp586J2118) | Hs.21851 | 72 | | |
| 73 | Resistant cells | NM_002585 | yes | pre-B-cell leukemia transcription factor 1 | Hs.155691 | 73 | 203 | NP_002576 |
| 74 | Resistant cells | T68445 | | anaphase-promoting complex subunit 7 | Hs.52763 | 74 | 204 | Q96AC4 |
| 75 | Resistant cells | BF308645 | | PRex1 KIAA1415 protein | Hs.109315 | 75 | 205 | Q8TCU6 |
| 76 | Resistant cells | AF088867 | yes | anterior gradient 2 (Xenopus laevis) homolog | Hs.413945 | 76 | 206 | AF088867_1 |
| 77 | Resistant cells | NM_004040 | yes | Human HepG2 3' region cDNA, clone hmd1f06. | Hs.204354 | 77 | 207 | NP_004031 |
| 78 | Resistant cells | AF151810 | yes | serologically defined colon cancer antigen 28 | Hs.84700 | 78 | 208 | Q9Y365 |
| 79 | Resistant cells | NM_004252 | | transmembrane 7 superfamily member 2 | Hs.31130 | 79 | 209 | NP_004243 |
| 80 | Resistant cells | NM_005749 | yes | transducer of ERBB2, 1 | Hs.178137 | 80 | 210 | NP_005740 |
| 81 | Resistant cells | NM_003225 | yes | trefoil factor 1 (breast cancer, estrogen-inducible sequence expressed in) | Hs.350470 | 81 | 211 | NP_003216 |
| 82 | Resistant cells | AA181060 | yes | Homo sapiens cDNA FLJ31753 fis, clone NT2RI2007468 | Hs.349283 | 82 | | |
| 83 | Resistant cells | AL050025 | | adaptor-related protein complex 1, gamma 1 subunit | Hs.5344 | 83 | 212 | CAB43244 |
| 84 | Resistant cells | NM_001089 | | ATP-binding cassette, sub-family A (ABC1), member 3 | Hs.26630 | 84 | 213 | NP_001080 |
| 85 | Resistant cells | NM_004915 | | ATP-binding cassette, sub-family G (WHITE), member 1 | Hs.10237 | 85 | 214 | NP_004906 |
| 86 | Resistant cells | AL523275 | | CALM1 calmodulin 1 (phosphorylase kinase, delta) | Hs.374441 | 86 | 215 | AAH00454 |
| 87 | Resistant cells | NM_001218 | yes | carbonic anhydrase XII | Hs.5338 | 87 | 216 | NP_001209 |
| 88 | Resistant cells | NM_016286 | | dicarbonyl/L-xylulose reductase | Hs.9857 | 88 | 217 | NP_057370 |
| 89 | Resistant cells | BC000185 | | carnitine palmitoyltransferase I, liver | Hs.259785 | 89 | 218 | AAH00185 |
| 90 | Resistant cells | NM_005505 | | scavenger receptor class B, member 1 | Hs.180616 | 90 | 219 | NP_005496 |
| 91 | Resistant cells | NM_016048 | | CGI-111 protein | Hs.11085 | 91 | 220 | NP_057132 |

TABLE 2-continued

Markers highly correlated to BMS-A in expression pattern and resistance/sensitivity classification

| Gene No. | Highly Expressed in | Genbank Accession # | Modulated by BMS-A | Unigene Title | Unigene Cluster | DNA SEQ ID NO: | Amino Acid SEQ ID NO: | Protein ID |
|---|---|---|---|---|---|---|---|---|
| 92 | Resistant cells | BC000195 | | CGI-81 protein | Hs.279583 | 92 | 221 | NP_057109 |
| 93 | Resistant cells | NM_001306 | | claudin 3 | Hs.25640 | 93 | 222 | NP_001297 |
| 94 | Resistant cells | BC000021 | | cytochrome b-561 | Hs.355264 | 94 | 223 | NP_001906 |
| 95 | Resistant cells | W68084 | | EGF-like-domain, multiple 5 | Hs.5599 | 95 | 224 | Q9H1U4 |
| 96 | Resistant cells | AA825563 | yes | ESTs | Hs.445708 | 96 | | |
| 97 | Resistant cells | BE887449 | | Homo sapiens cDNA FLJ34170 fis, clone FCBBF3015396. | Hs.32112 | 97 | | |
| 98 | Resistant cells | AI123815 | yes | hypothetical protein FLJ21963 | Hs.13222 | 98 | 225 | Q9H6R3 |
| 99 | Resistant cells | AI308862 | | RAB21, member RAS oncogene family | Hs.184627 | 99 | 226 | Q9UL25 |
| 100 | Resistant cells | AW006352 | | EST | Hs.159643 | 100 | | |
| 101 | Resistant cells | AL554277 | | chromosome 17 open reading frame 28 | Hs.11067 | 101 | 227 | Q9NT34 |
| 102 | Resistant cells | BG289001 | | hypothetical protein LOC253782 | Hs.387400 | 102 | | |
| 103 | Resistant cells | AI935915 | | hypothetical protein LOC112868 | Hs.97837 | 103 | 228 | XP_053402 |
| 104 | Resistant cells | NM_017689 | yes | hypothetical protein FLJ20151 | Hs.279916 | 104 | 229 | NP_060159 |
| 105 | Resistant cells | NM_017966 | | hypothetical protein FLJ20847 | Hs.13479 | 105 | 230 | NP_060436 |
| 106 | Resistant cells | AI923458 | | Williams Beuren syndrome chromosome region 21 | Hs.182476 | 106 | 231 | NP_112585 |
| 107 | Resistant cells | NM_000597 | | insulin-like growth factor binding protein 2 (36 kD) | Hs.433326 | 107 | 232 | NP_000588 |
| 108 | Resistant cells | U90304 | | iroquois homeobox protein 5 | Hs.25351 | 108 | 233 | P78411 |
| 109 | Resistant cells | NM_004968 | | islet cell autoantigen 1 (69 kD) | Hs.167927 | 109 | 234 | NP_004959 |
| 110 | Resistant cells | AL563283 | | androgen-induced basic leucine zipper | Hs.372924 | 110 | 235 | NP_570968 |
| 111 | Resistant cells | AA135522 | | KIAA0089 protein | Hs.82432 | 111 | 236 | AAH28726 |
| 112 | Resistant cells | AI867102 | yes | solute carrier family 9 (sodium/hydrogen exchanger), isoform 3 regulator factor 1 | Hs.184276 | 112 | 237 | XP_051621 |
| 113 | Resistant cells | AW134976 | | KIAA0984 protein | Hs.11912 | 113 | 238 | BAA76828 |
| 114 | Resistant cells | AW665865 | | KIAA1069 protein | Hs.193143 | 114 | 239 | BAA83021 |
| 115 | Resistant cells | AB051487 | | nucleoporin 210 | Hs.270404 | 115 | 240 | BAB40814 |
| 116 | Resistant cells | AB050049 | | methylcrotonoyl-Coenzyme A carboxylase 2 (beta) | Hs.167531 | 116 | 241 | Q9HCC0 |
| 117 | Resistant cells | NM_016835 | | microtubule-associated protein tau | Hs.101174 | 117 | 242 | NP_058519 |
| 118 | Resistant cells | AK002075 | | myelin gene expression factor 2 | Hs.44268 | 118 | 243 | NP_057216 |
| 119 | Resistant cells | NM_000933 | | Homo sapiens mRNA; cDNA DKFZp434E235 (from clone DKFZp434E235) | Hs.348724 | 119 | 244 | NP_000924 |
| 120 | Resistant cells | AI435670 | | prostate epithelium-specific Ets transcription factor | Hs.79414 | 120 | 245 | NP_036523 |
| 121 | Resistant cells | NM_006443 | | putative c-Myc-responsive | Hs.109752 | 121 | 246 | NP_006434 |
| 122 | Resistant cells | AW263542 | | ESTs | Hs.403937 | 122 | | AAH15948 |
| 123 | Resistant cells | AF153330 | | dual specificity phosphatase 16 | Hs.20281 | 123 | 247 | Q9BY84 |
| 124 | Resistant cells | BC002702 | | solute carrier family 25 (mitochondrial carrier; ornithine transporter) member 15 | Hs.78457 | 124 | 248 | Q9Y619 |
| 125 | Resistant cells | NM_006416 | | solute carrier family 35 (CMP-sialic acid transporter), member 1 | Hs.82921 | 125 | 249 | NP_006407 |
| 126 | Resistant cells | NM_030674 | | solute carrier family 38, member 1 | Hs.18272 | 126 | 250 | NP_109599 |
| 127 | Resistant cells | AF212371 | | spinster-like protein | Hs.379091 | 127 | 251 | AAH08325 |
| 128 | Resistant cells | AF096304 | | solute carrier family 19 (thiamine transporter), member 2 | Hs.30246 | 128 | 252 | AAD09765 |
| 129 | Resistant cells | AK000948 | | trichorhinophalangeal syndrome I | Hs.26102 | 129 | 253 | Q9UHF7 |
| 130 | Resistant cells | AI859834 | | ESTs, Moderately similar to hypothetical protein FLJ20489 | Hs.445020 | 130 | | |
| 131 | Resistant cells | BF512846 | | ESTs | Hs.442762 | 131 | | |
| 132 | Resistant cells | NM_022969 | yes | fibroblast growth factor receptor 2 (bacteria-expressed kinase, keratinocyte growth factor receptor, craniofacial dysostosis 1, Crouzon syndrome, syndrome, Pfeiffer syndrome, Jackson-Weiss syndrome) | Hs.278581 | 132 | 254 | NP_075258 |
| 133 | Resistant cells | AA741493 | yes | ESTs | Hs.143842 | 133 | | |
| 134 | Resistant cells | NM_001424 | | epithelial membrane protein 2 | Hs.29191 | 134 | 255 | P54851 |
| 135 | Resistant cells | AW242920 | yes | ESTs | Hs.129368 | 135 | | |
| 136 | Resistant cells | W44413 | | small protein effector 1 of Cdc42 | Hs.22065 | 136 | 256 | Q9HB17 |
| 137 | Resistant cells | AK021717 | | Homo sapiens cDNA FLJ11655 fis, clone HEMBA1004554 | Hs.287436 | 137 | | |

Table 3 presents a resistance/sensitivity prediction of the 23 breast cell lines for BMS-A in the 'leave one out' cross validation test using a Weighted Voting algorithm. The true class is assigned as in Table 1, based on the $IC_{50}$ results. The predicted class was determined by using the optimal 15 and 7 polynucleotides as the predictor set to predict the resistance or sensitive class. These polynucleotides were selected either from the 137 polynucleotides derived from three analysis methods as shown in Table 2, or from 40 drug treatment modulated polynucleotides as indicated in Table 2. "S" represents Sensitive; "R" represents Resistant. The PS score refers to prediction strength for each prediction made on a cell line by the predictor set. The PS score ranges from 0 to 1, i.e., corresponding from low to high confidence in making the prediction. The error predictions are indicated by an asterisk (*).

TABLE 3

| | | 15 markers from 137 poly-nucleotides in Table 2 | | | 7 modulated markers from 40 polynucleo-tides as indicated in Table 2 | | |
|---|---|---|---|---|---|---|---|
| Cell Line | True Class | Predict-ed Class | PS score | Error? | Predict-ed Class | PS score | Error? |
| MDAMB157 | S | S | 0.627 | | S | 0.696 | |
| MDAMB231 | S | S | 0.857 | | S | 1.000 | |
| HCC1954 | S | S | 0.416 | | S | 0.847 | |
| HCC70 | S | S | 0.695 | | S | 1.000 | |
| BT20 | S | S | 0.586 | | S | 0.794 | |
| HCC1806 | S | S | 0.985 | | S | 1.000 | |
| Hs578T | S | S | 0.775 | | S | 0.570 | |
| HCC1419 | R | R | 1.000 | | R | 1.000 | |
| SkBr3 | R | R | 0.852 | | R | 0.992 | |
| AU565 | R | R | 0.629 | | R | 0.763 | |
| HCC38 | R | S | 0.101 | * | S | 0.501 | * |
| BT474 | R | R | 0.938 | | R | 1.000 | |
| MDAMB468 | R | R | 0.392 | | R | 0.416 | |
| HCC1428 | R | R | 0.623 | | R | 0.939 | |
| MDAMB435S | R | S | 0.723 | * | R | 0.324 | |
| H3396 | R | R | 1.000 | | R | 1.000 | |
| BT549 | R | R | 0.029 | | R | 0.012 | |
| Zr-75-30 | R | R | 0.958 | | R | 1.000 | |
| MCF7 | R | R | 0.911 | | R | 1.000 | |
| Her2MCF7 | R | R | 0.991 | | R | 1.000 | |
| MDAMB436 | R | R | 0.340 | | R | 0.412 | |
| Zr-75-1 | R | R | 1.000 | | R | 1.000 | |
| MDAMB453 | R | R | 0.983 | | R | 1.000 | |

Table 4 lists the predictor set of 15 polynucleotides used in prediction as shown in Table 3. These 15 polynucleotides were selected from the 137 polynucleotides derived from three analysis methods as shown in Table 2. The relative expression pattern, i.e., sensitive or resistant, polynucleotide description and Unigene cluster number for this 15 predictor polynucleotide subset are indicated in Table 4.

TABLE 4

| Highly Expressed in: | Modulated by BMS-A | Unigene Title | Unigene Cluster No |
|---|---|---|---|
| Sensitive cells | | EphB2 | Hs.125124 |
| Sensitive cells | | parvin, alpha | Hs.44077 |
| Sensitive cells | yes | coagulation factor II (thrombin) receptor-like 1 | Hs.154299 |
| Sensitive cells | yes | aldo-keto reductase family 1, member C3 | Hs.78183 |
| Sensitive cells | yes | interferon, gamma-inducible protein 16 | Hs.155530 |
| Sensitive cells | yes | jagged 1 (Alagille syndrome) | Hs.91143 |
| Sensitive cells | | hypothetical protein MGC13105 | Hs.22744 |
| Sensitive cells | | snail homolog 2 (*Drosophila*) | Hs.93005 |
| Resistant cells | | *Homo sapiens* mRNA cDNA DKFZp761C1712 | Hs.4774 |
| Resistant cells | yes | *Homo sapiens* cDNA FLJ31753 fis, clone NT2RI2007468 | Hs.349283 |
| Resistant cells | | ATP-binding cassette, sub-family A (ABC1), member 3 | Hs.26630 |
| Resistant cells | | CGI-81 protein | Hs.279583 |
| Resistant cells | yes | ESTs | Hs.445708 |
| Resistant cells | | EST | Hs.159643 |
| Resistant cells | | hypothetical protein LOC112868 | Hs.97837 |

Table 5 lists the predictor set of 7 polynucleotides used in prediction as shown in Table 3. These 7 polynucleotides were selected from the 40 polynucleotides that were modulated by drug treatment as indicated in Table 2. The relative expression pattern, i.e., sensitive or resistant, polynucleotide description and Unigene cluster number for this 7 predictor polynucleotide subset are indicated in Table 5.

TABLE 5

| Highly Expressed in: | Modulated by BMS-A | Unigene Title | Unigene Cluster No |
|---|---|---|---|
| Resistant cells | yes | *Homo sapiens* cDNA FLJ31753 fis, clone NT2RI2007468 | Hs.349283 |
| Sensitive cells | yes | jagged 1 (Alagille syndrome) | Hs.91143 |
| Sensitive cells | yes | interferon, gamma-inducible protein 16 | Hs.155530 |
| Sensitive cells | yes | coagulation factor II (thrombin) receptor-like 1 | Hs.154299 |

TABLE 5-continued

| Highly Expressed in: | Modulated by BMS-A | Unigene Title | Unigene Cluster No |
|---|---|---|---|
| Resistant cells | yes | ESTs | Hs.445708 |
| Sensitive cells | yes | aldo-keto reductase family 1, member C3 | Hs.78183 |
| Sensitive cells | yes | polymerase I and transcript release factor | Hs.29759 |

Table 6 lists the representative RT-PCR primer sets for each of the protein tyrosine kinase biomarker polynucleotides of the present invention. The SEQ ID NO: for each RT-PCR primer is provided (SEQ ID NO:257 thru 530).

TABLE 6

| Genbank Accession No. | RT-PCR Primer Type | Rt-PCR Primer Sequence | SEQ ID NO: |
|---|---|---|---|
| NM_004431 | Forward Primer | TCCTCACACTAAGAGGGCAGA | 257 |
| NM_004431 | Reverse Primer | ACCTCAACACAACCAAGCATC | 258 |
| AF025304 | Forward Primer | TCAGTGAGTACAACGCCACAG | 259 |
| AF025304 | Reverse Primer | CTTCTCCTGGATGCTTGTCTG | 260 |
| NM_001753 | Forward Primer | CCACCTTCACTGTGACGAAAT | 261 |
| NM_001753 | Reverse Primer | CCAGATGTGCAGGAAAGAGAG | 262 |
| NM_001233 | Forward Primer | AGCTGTCTGCACATCTGGATT | 263 |
| NM_001233 | Reverse Primer | CCTGGGGTCCAAGTATTCAAT | 264 |
| NM_000700 | Forward Primer | CATCAAGCCATGAAAGGTGTT | 265 |
| NM_000700 | Reverse Primer | ACAAAGAGCCACCAGGATTTT | 266 |
| NM_004039 | Forward Primer | GAACTGATGTTCCCAAGTGGA | 267 |
| NM_004039 | Reverse Primer | AACCAGGTTCAGGAAAGCATT | 268 |
| BG107577 | Forward Primer | TTTCGTGAACAAGCACCTGA | 269 |
| BG107577 | Reverse Primer | ATGAGCTCAAAGGCAAAGGA | 270 |
| BE965369 | Forward Primer | GTTTAAAATCCGGATTGGCAT | 271 |
| BE965369 | Reverse Primer | GTGGCCGTGATAATTTTTGAA | 272 |
| NM_001993 | Forward Primer | AAAATGGAAGGAAATTGGGTG | 273 |
| NM_001993 | Reverse Primer | TGCCCAGAATACCAATGTCTC | 274 |
| BF792126 | Forward Primer | TCGGTGAATTCAAGGACCAT | 275 |
| BF792126 | Reverse Primer | GCTGCCTTCAAGGATCTCAC | 276 |
| E856341 | Forward Primer | TGCCAGGTAAAGCTCTGTCC | 277 |
| E856341 | Reverse Primer | GTCCTGTGGATGAGCATGTG | 278 |
| U17496 | Forward Primer | ATCTCCAGAGCTCGCTTTACC | 279 |
| U17496 | Reverse Primer | TTCACCCGTAAGGCACTAATG | 280 |
| NM_002800 | Forward Primer | TATGGTTATGTGGATGCAGCA | 281 |
| NM_002800 | Reverse Primer | AGATGACTCGATGGTCCACAC | 282 |
| NM_000311 | Forward Primer | CCGAGTAAGCCAAAAACCAA | 283 |
| NM_000311 | Reverse Primer | CTCATCCATGGGCCTGTAGT | 284 |
| NM_003739 | Forward Primer | GGTGAGGAACTTTCACCAACA | 285 |
| NM_003739 | Reverse Primer | CTTGAGTCCTGGCTTGTTGAG | 286 |

TABLE 6-continued

| Genbank Accession No. | RT-PCR Primer Type | Rt-PCR Primer Sequence | SEQ ID NO: |
|---|---|---|---|
| NM_020639 | Forward Primer | TACTTGGGTGAGTCCTTGTGG | 287 |
| NM_020639 | Reverse Primer | GACTCTTAGGCCTGTGGCTCT | 288 |
| AF208043 | Forward Primer | GGAGTAAGGTGTCCGAGGAAC | 289 |
| AF208043 | Reverse Primer | CTGACATTTGGCCACTGTTTT | 290 |
| AF003837 | Forward Primer | CCTGTAACATAGCCCGAAACA | 291 |
| AF003837 | Reverse Primer | AGTTGTCTCCATCCACACAGG | 292 |
| BC002832 | Forward Primer | ACGTGTATGCAGATGGAAAGG | 293 |
| BC002832 | Reverse Primer | CAGAGGCTGTGACGTTGTGTA | 294 |
| NM_006994 | Forward Primer | AATTTGTGCAGTTGGGAGATG | 295 |
| NM_006994 | Reverse Primer | TGATCTCTACCCTGCAGCTGT | 296 |
| AF327443 | Forward Primer | CATCTGACTTCACCTGTGGGT | 297 |
| AF327443 | Reverse Primer | TTCTGACTGTCCCTGCTGACT | 298 |
| NM_021615 | Forward Primer | ACCCCGACGTCTTCTACCTAA | 299 |
| NM_021615 | Reverse Primer | GCAGATAGGCATCAAACACGT | 300 |
| AF104857 | Forward Primer | AGTTCCCTGGGCATAATGAGT | 301 |
| AF104857 | Reverse Primer | AACATGAGAGCTTGGGATCCT | 302 |
| AL136896 | Forward Primer | AGCCGAATCCACTCTCATGT | 303 |
| AL136896 | Reverse Primer | TAACAAGGCACAGCAAGCAG | 304 |
| AL565621 | Forward Primer | CTCAGACCTTTGCCCTTCTCT | 305 |
| AL565621 | Reverse Primer | TCCGGCTCAGACTGAATAAGA | 306 |
| BF111719 | Forward Primer | CACACATGGGCATTTGCTTA | 307 |
| BF111719 | Reverse Primer | GGATATGCAGTGGGAAGGAA | 308 |
| BC020608 | Forward Primer | CACCGAGAATCCTTACACCAA | 309 |
| BC020608 | Reverse Primer | CAGAATCCATCCTCCTTCCTC | 310 |
| AW575374 | Forward Primer | CATGCACACACACACAGAATG | 311 |
| AW575374 | Reverse Primer | TTTCCTTTGGAAACTGGGATT | 312 |
| NM_001401 | Forward Primer | CTTGCTGAATTCAACTCTGCC | 313 |
| NM_001401 | Reverse Primer | AAACCACAGAGTGGTCATTGC | 314 |
| BC001247 | Forward Primer | AGGAGAAGGAAGACAAGCCAG | 315 |
| BC001247 | Reverse Primer | CTTGCTGATTTCGTCTTCAGG | 316 |
| BE669858 | Forward Primer | CTGCTTGAGACTGTTCTGGCT | 317 |
| BE669858 | Reverse Primer | GATTAGAGGGCTTCCTCATGG | 318 |
| NM_000127 | Forward Primer | CAAGGGGAAGAGGTACCTGAC | 319 |
| NM_000127 | Reverse Primer | TCTGTCACAGCGAGAATCCTT | 320 |
| NM_002589 | Forward Primer | GACTCTGGGCGTCTCTGAAG | 321 |
| NM_002589 | Reverse Primer | CAGCAACAAGCCAGTCTCAA | 322 |
| AI133452 | Forward Primer | ACATCATGAGTTGGTCCTTGC | 323 |
| AI133452 | Reverse Primer | AATCTGCAATGCCACAGGTAG | 324 |

TABLE 6-continued

| Genbank Accession No. | RT-PCR Primer Type | Rt-PCR Primer Sequence | SEQ ID NO: |
|---|---|---|---|
| NM_006101 | Forward Primer | TCCTCATACATGGCCTCACA | 325 |
| NM_006101 | Reverse Primer | TGTCGGCACCACTCATAAAA | 326 |
| AL135264 | Forward Primer | GGTGCAGGTTGACACTGAAA | 327 |
| AL135264 | Reverse Primer | AAGGTTCACCAGGACACAGG | 328 |
| NM_014164 | Forward Primer | ATCACAGGCATCATCATCCTC | 329 |
| NM_014164 | Reverse Primer | GGTTGTCAGCTCCTGTTTCTG | 330 |
| BC003502 | Forward Primer | GGGGTGTAGGTGGGAGTCAC | 331 |
| BC003502 | Reverse Primer | AGTGCCTTCAGCCAAAATGT | 332 |
| AA780067 | Forward Primer | GCCATCCTCTTGATAAGCTGA | 333 |
| AA780067 | Reverse Primer | TCTTCCCAGGATTCTCTTTGG | 334 |
| AA702248 | Forward Primer | GATTGCAGATCCTATGCAGGA | 335 |
| AA702248 | Reverse Primer | GCATCCAGGACAACACAAAGT | 336 |
| BC004372 | Forward Primer | AAGGTGGAGCAAACACAACC | 337 |
| BC004372 | Reverse Primer | TCCACTTGGCTTTCTGTCCT | 338 |
| BF688144 | Forward Primer | CAAGTGCCCATTTAGGTTTGA | 339 |
| BF688144 | Reverse Primer | ACTGACAGATGGCTCATTTGG | 340 |
| NM_018067 | Forward Primer | GAACACCAGAGACACTCCTGC | 341 |
| NM_018067 | Reverse Primer | ACATCCTGGTAGGTGATGCAG | 342 |
| BG11761 | Forward Primer | CGCATCTGTCCAGCATCTTA | 343 |
| BG11761 | Reverse Primer | CAAAACCGGGACGCTAACT | 344 |
| NM_017821 | Forward Primer | AGAAACAGTGGATCACGTTGG | 345 |
| NM_017821 | Reverse Primer | TTCCAAGGGAATACCCAAAAC | 346 |
| AA722799 | Forward Primer | GTTTCCACTTTTCCCAGTGC | 347 |
| AA722799 | Reverse Primer | TCACATGAAACGATTCTCTGCT | 348 |
| BC006436 | Forward Primer | AATGTCAAAAGTGTGGGCAAG | 349 |
| BC006436 | Reverse Primer | ATGTGGACCGAGTAAAGGCTT | 350 |
| NM_006548 | Forward Primer | CAGTCCCGGGTAGATATCCAT | 351 |
| NM_006548 | Reverse Primer | TCTTCGGCTAGTTTGGTCTCA | 352 |
| NM_002194 | Forward Primer | TGATTTGCCACAGTTGGTGTA | 353 |
| NM_002194 | Reverse Primer | CTAGGTATGCGTCTCTGCAGG | 354 |
| BG251556 | Forward Primer | CAGCCTGGTTTACAAATTCCA | 355 |
| BG251556 | Reverse Primer | TGGGGAAAACTAAGGCAAAGT | 356 |
| J03202 | Forward Primer | CAACAATGAAGCCTGCTCTTC | 357 |
| J03202 | Reverse Primer | CCTGCTTCAGTGAGAGAATGG | 358 |
| NM_000245 | Forward Primer | AGGACCGGTTCATCAACTTCT | 359 |
| NM_000245 | Reverse Primer | TCAATGTAGGACTGGTCCGTC | 360 |
| NM_002444 | Forward Primer | AAATGGTGCCTTCAAGACCTT | 361 |
| NM_002444 | Reverse Primer | CCGGCCTATACTCCTACAAGG | 362 |

TABLE 6-continued

| Genbank Accession No. | RT-PCR Primer Type | Rt-PCR Primer Sequence | SEQ ID NO: |
|---|---|---|---|
| NM_012334 | Forward Primer | TAATGGTGGTCTGAACAAGGC | 363 |
| NM_012334 | Reverse Primer | AGTTGGCCCAAGTCCTTAAAA | 364 |
| AI769569 | Forward Primer | CATGGAGGAGCCATACAACA | 365 |
| AI769569 | Reverse Primer | TTTGTCCTGCTCCCAAATTC | 366 |
| NM_002633 | Forward Primer | TGCTTTGTATGAGACCCCAAC | 367 |
| NM_002633 | Reverse Primer | CATCTTTCTCACGGATGTGGT | 368 |
| BC004295 | Forward Primer | AGAAGACAGAGAGGTCAGCCC | 369 |
| BC004295 | Reverse Primer | TGGGACCCTAATTTTCTGGAC | 370 |
| NM_016205 | Forward Primer | ACCCTTGAGTTTTCGCCTCT | 371 |
| NM_016205 | Reverse Primer | GGATCAAAGCAAAACCTGGA | 372 |
| NM_004815 | Forward Primer | GCCCCTTTTGTATAGGACTGC | 373 |
| NM_004815 | Reverse Primer | AATTCCAGTGAGGCACAAATG | 374 |
| NM_002872 | Forward Primer | CAAGACCTGCCTTCTCATCAG | 375 |
| NM_002872 | Reverse Primer | GAAGACGTCCGTCTGTGGATA | 376 |
| AF329267 | Forward Primer | CAATTCTCTCAGCAGACCTGG | 377 |
| AF329267 | Reverse Primer | ACCACGGAGTCAAAACCTTCT | 378 |
| AI572079 | Forward Primer | CCCCAAGGCACATACTGTTAA | 379 |
| AI572079 | Reverse Primer | TGCCCATTGTTGAACTAAAGC | 380 |
| NM_001549 | Forward Primer | GAACATGCTGACCAAGCAGA | 381 |
| NM_001549 | Reverse Primer | CAGTTGTGTCCACCCTTCCT | 382 |
| D50683 | Forward Primer | AACAATACTGGCTGATCACCG | 383 |
| D50683 | Reverse Primer | CATGGAGTGTGATCACTGTGG | 384 |
| NM_005902 | Forward Primer | GGACTGCAGTGTGGAGTTCA | 385 |
| NM_005902 | Reverse Primer | GAGAGGGGAGGGAGACAGAC | 386 |
| NM_014452 | Forward Primer | GGTTTATAAGCCTTTGCCAGG | 387 |
| NM_014452 | Reverse Primer | GTGGGAAAAGTCACACTGCAT | 388 |
| AB017644 | Forward Primer | CTCCTCCTAATTGCAGTGCTG | 389 |
| AB017644 | Reverse Primer | GTGATAGATTCTGGTGCGGAA | 390 |
| BC002323 | Forward Primer | CCTCAGGTCCAACTCCATGT | 391 |
| BC002323 | Reverse Primer | GTGCCCCAATTTTTGATTTG | 392 |
| AL157452 | Forward Primer | AGCCTTGTCTCCCTTGGATT | 393 |
| AL157452 | Reverse Primer | TCAGTTGCCCCTCTACAACC | 394 |
| BF752277 | Forward Primer | AAGGCCCTGGATTCTCACTC | 395 |
| BF752277 | Reverse Primer | GCCAGGACACCTTCAGAGAG | 396 |
| BF512299 | Forward Primer | AAGAGCCTCCCAAAGGAAA | 397 |
| BF512299 | Reverse Primer | GGGAAATGAAAGTGGCAAGA | 398 |
| AL049381 | Forward Primer | TTGTTGGTTTTATTCTCCCCC | 399 |
| AL049381 | Reverse Primer | CAGTTGGAATCAAAAGGGACA | 400 |

TABLE 6-continued

| Genbank Accession No. | RT-PCR Primer Type | Rt-PCR Primer Sequence | SEQ ID NO: |
|---|---|---|---|
| NM_002585 | Forward Primer | AGTGAGGAAGCCAAAGAGGAG | 401 |
| NM_002585 | Reverse Primer | TTTGGCAGCATAAATATTGGC | 402 |
| T68445 | Forward Primer | CAGAGAGGGAACCACCAGAG | 403 |
| T68445 | Reverse Primer | CCCTGGGGAAATTAAAATGA | 404 |
| BF308645 | Forward Primer | CTCTGTCGGGAAGGAGAGA | 405 |
| BF308645 | Reverse Primer | GAACTTTGACGACACCGACA | 406 |
| AF088867 | Forward Primer | CTCTGGCCAGAGATACCACAG | 407 |
| AF088867 | Reverse Primer | CATCAAGGGTTTGTTGCTTGT | 408 |
| NM_004040 | Forward Primer | AACTATGTGGCCGACATTGAG | 409 |
| NM_004040 | Reverse Primer | CACCGAGAAGCACATGAGAAT | 410 |
| AF151810 | Forward Primer | CCTGAAGAACCGTGATGTCAT | 411 |
| AF151810 | Reverse Primer | CTGTGCTCTGGATGAGGTAGC | 412 |
| NM_004252 | Forward Primer | CACATCCCCTTTCTTGACAAA | 413 |
| NM_004252 | Reverse Primer | GATGAGGCACTCAGTGAGGAG | 414 |
| NM_005749 | Forward Primer | TTGAAACCTAATTTTGTGGCG | 415 |
| NM_005749 | Reverse Primer | AAATGTTGACACGTCTCCTGG | 416 |
| NM_003225 | Forward Primer | CCTAATACCATCGACGTCCCT | 417 |
| NM_003225 | Reverse Primer | AGCTCTGGGACTAATCACCGT | 418 |
| AA181060 | Forward Primer | AAAAGGCTGACAAACTGACCA | 419 |
| AA181060 | Reverse Primer | TCACAGCCTAGGTAAGAGCCA | 420 |
| AL050025 | Forward Primer | CAGGTACGAATTTTGCGGTTA | 421 |
| AL050025 | Reverse Primer | TCGCAATCCACTCTCTGACTT | 422 |
| NM_001089 | Forward Primer | CTCCTTCAGCTTCATGGTCAG | 423 |
| NM_001089 | Reverse Primer | TCTGGCTCAGAGTCATCCAGT | 424 |
| NM_004915 | Forward Primer | CAACCCAGCAGATTTTGTCAT | 425 |
| NM_004915 | Reverse Primer | CGAGGTCTCTCTTGTGGTCTG | 426 |
| AL523275 | Forward Primer | TCTTTGCATTGAGATTGGTCC | 427 |
| AL523275 | Reverse Primer | ACCGTGAAAAATGCACATCTC | 428 |
| NM_001218 | Forward Primer | CCTTCAATCCGTCCTATGACA | 429 |
| NM_001218 | Reverse Primer | GGAAGCAGCTCTTCAATGTTG | 430 |
| NM_016286 | Forward Primer | GAGTGAATGCAGTAAACCCCA | 431 |
| NM_016286 | Reverse Primer | CACTCAGCAGAAAGAGGATGG | 432 |
| BC000185 | Forward Primer | CATCGAGGACGCTACTTCAAG | 433 |
| BC000185 | Reverse Primer | AAAATAGGCCTGACGACACCT | 434 |
| NM_005505 | Forward Primer | TTGGACAAACTGGGAAGATTG | 435 |
| NM_005505 | Reverse Primer | ACGTACTGGGCATAGTGCATC | 436 |
| NM_016048 | Forward Primer | GGGGATATTATTAGCGTGGGA | 437 |
| NM_016048 | Reverse Primer | TGCCGCTTCTACTTCTGGTAA | 438 |

TABLE 6-continued

| Genbank Accession No. | RT-PCR Primer Type | Rt-PCR Primer Sequence | SEQ ID NO: |
|---|---|---|---|
| BC000195 | Forward Primer | TCCACTCACATTTCCTATCGG | 439 |
| BC000195 | Reverse Primer | GATTCCATTTACGGGGAAAAA | 440 |
| NM_001306 | Forward Primer | AACCTGCATGGACTGTGAAAC | 441 |
| NM_001306 | Reverse Primer | AATATCAAGTGCCCCTTCCAG | 442 |
| BC000021 | Forward Primer | GCAAGTATAGCGCATTTGAGC | 443 |
| BC000021 | Reverse Primer | CGTCTTGAAGTCCATGGAGAG | 444 |
| W68084 | Forward Primer | TTAGATCTGAAGCCCTGGGTT | 445 |
| W68084 | Reverse Primer | TGCTTGGTGAACATAACACCA | 446 |
| AA825563 | Forward Primer | AGAAGAAAAACCCAAATGGCA | 447 |
| AA825563 | Reverse Primer | TCCATAGTGGTTTTTACCAGCA | 448 |
| BE887449 | Forward Primer | TGCGTACCAGGATTGGTTAAG | 449 |
| BE887449 | Reverse Primer | GATGTCCAACAAAACGCTCAT | 450 |
| AI123815 | Forward Primer | TGAGCATGGTATACTTTTGGG | 451 |
| AI123815 | Reverse Primer | AAGCTTATAGGAATGGGCCAG | 452 |
| AI308862 | Forward Primer | TGGGAAAATTTAAAACCCACA | 453 |
| AI308862 | Reverse Primer | TCAAAGTGCCCTTTGGTAGTG | 454 |
| AW006352 | Forward Primer | TCCTCAAACACAAAATCCCAG | 455 |
| AW006352 | Reverse Primer | CTCCTACTATGGGCCTCCAAC | 456 |
| AL554277 | Forward Primer | GAAGCAGATCGTCCTGAACTG | 457 |
| AL554277 | Reverse Primer | GCTCATCATCCTCTTCTCCCT | 458 |
| BG289001 | Forward Primer | TCCCAATAGCTTGTGGATCAG | 459 |
| BG289001 | Reverse Primer | ATCAACCAGGAAGCCAACTTT | 460 |
| AI935915 | Forward Primer | GACCAACACCTCTCCTAAGGG | 461 |
| AI935915 | Reverse Primer | GTTGGGAGGGGACCATAGTTA | 462 |
| NM_017689 | Forward Primer | GAAATAGCAAAACAAGGCCC | 463 |
| NM_017689 | Reverse Primer | CAATGCAGCACATGCTAGAAA | 464 |
| NM_017966 | Forward Primer | CAGAATGTAAAGGGTGGGAT | 465 |
| NM_017966 | Reverse Primer | CCCTGAGACCTGGTTTACCTC | 466 |
| AI923458 | Forward Primer | GATGGCAGCTATGAAGTCCTG | 467 |
| AI923458 | Reverse Primer | GCATTCCAGCTATCACCTGAA | 468 |
| NM_000597 | Forward Primer | CACCTCTACTCCCTGCACATC | 469 |
| NM_000597 | Reverse Primer | AGAAGAGATGACACTCGGGGT | 470 |
| U90304 | Forward Primer | TTTGGCTAAAGACCCGAAAAT | 471 |
| U90304 | Reverse Primer | TCTCTCTCTCTCGGTGATGGA | 472 |
| NM_004968 | Forward Primer | GAGCAGGAAAGATGATGCAAG | 473 |
| NM_004968 | Reverse Primer | AAGTATCTGAGATGGCCCGAT | 474 |
| AL563283 | Forward Primer | CTCTGGAATGGACTGAAGCTG | 475 |
| AL563283 | Reverse Primer | AAAAGTCCAGGAGCTGGAGAG | 476 |

TABLE 6-continued

| Genbank Accession No. | RT-PCR Primer Type | Rt-PCR Primer Sequence | SEQ ID NO: |
|---|---|---|---|
| AA135522 | Forward Primer | CACCTCATCACAACACCCTCT | 477 |
| AA135522 | Reverse Primer | TGCTAGGATCCACCCTCCTAT | 478 |
| AI867102 | Forward Primer | CTCTTCCCAGCTCCTGATTCT | 479 |
| AI867102 | Reverse Primer | CTGAAGGACTGAAGGGAGCTT | 480 |
| AW134976 | Forward Primer | ACATGCTGTGTGGTAGAGGCT | 481 |
| AW134976 | Reverse Primer | AACATGCATGCATTGTACCAA | 482 |
| AW665865 | Forward Primer | TTCCAGGAAGAACATCATTGC | 483 |
| AW665865 | Reverse Primer | CTTTTCCTTCAGGGAACCAAG | 484 |
| AB051487 | Forward Primer | TTCTCAGCCAAAGCAGATGTT | 485 |
| AB051487 | Reverse Primer | TGCTTCTCCTCAGCAATTTGT | 486 |
| AB050049 | Forward Primer | ACTATGGGATGTGTGGCAGAG | 487 |
| AB050049 | Reverse Primer | GCTCTTTTAAAGCCGCTTCAT | 488 |
| NM_016835 | Forward Primer | AAAGAGGCTGACCTTCCAGAG | 489 |
| NM_016835 | Reverse Primer | AAGGCAAGGCCTATTTTTCAA | 490 |
| AK002075 | Forward Primer | GAAGCAATGAATAGCATGGGA | 491 |
| AK002075 | Reverse Primer | CCATTCCTCCAGTCACACTGT | 492 |
| NM_000933 | Forward Primer | TCGGTCTTGGCTACTTGAAGA | 493 |
| NM_000933 | Reverse Primer | CAGCGTTCCAGAAAATCTGAG | 494 |
| NM_012391 | Forward Primer | AAGGAGTTGCTACTCAAGCCC | 495 |
| NM_012391 | Reverse Primer | CTTGTAATACTGGCGGATGGA | 496 |
| NM_006443 | Forward Primer | CCATCCTTGGGTGTAGGCTAT | 497 |
| NM_006443 | Reverse Primer | CTCGAAGTATCGATCCAGCAG | 498 |
| BC015948 | Forward Primer | ATGTGCCCTCACATCTGTTTC | 499 |
| BC015948 | Reverse Primer | GGGTTTTAACAGCAGGGTAGC | 500 |
| AF153330 | Forward Primer | GAAATCAGTCTACCAAGGGGC | 501 |
| AF153330 | Reverse Primer | CGACTTTGCAATCTTGACACA | 502 |
| BC002702 | Forward Primer | GAAGAGTGGGCAAACATGAAA | 503 |
| BC002702 | Reverse Primer | CCCACCTGGGAGTAAGTCTTC | 504 |
| NM_006416 | Forward Primer | CCAGGTGACCTACCAGTTGAA | 505 |
| NM_006416 | Reverse Primer | TTCCACCACCACTTTTGTAGC | 506 |
| NM_030674 | Forward Primer | TGGCAAACACTGGAATCCTAC | 507 |
| NM_030674 | Reverse Primer | TCTGTAGAGAGGTGGCTCCAA | 508 |
| AF212371 | Forward Primer | CGGATGCTCAGCATCTTCTAC | 509 |
| AF212371 | Reverse Primer | ACTACCAGGAACAGCAGCAGA | 510 |
| AF096304 | Forward Primer | AGGCAATCCGATTTACGACTT | 511 |
| AF096304 | Reverse Primer | CTCTGCCTCCTTCATCAACAG | 512 |
| AK000948 | Forward Primer | AGAAGGACTTCTCCAGCAAGG | 513 |
| AK000948 | Reverse Primer | CTGGGACAGAATGGACAGTGT | 514 |

TABLE 6-continued

| Genbank Accession No. | RT-PCR Primer Type | Rt-PCR Primer Sequence | SEQ ID NO: |
|---|---|---|---|
| AI859834 | Forward Primer | TGGCCATTCAGACAGCATTA | 515 |
| AI859834 | Reverse Primer | CAGCTACTTGGGAGGCTGAG | 516 |
| BF512846 | Forward Primer | GGGCCCACTTGACTCATTTA | 517 |
| BF512846 | Reverse Primer | GCCTGCAGAGATCTCACTTTG | 518 |
| NM_022969 | Forward Primer | ACAGGATGGGCCTCTCTATGT | 519 |
| NM_022969 | Reverse Primer | TCCTCAGGAACACGGTTAATG | 520 |
| AA741493 | Forward Primer | ACACCTTGGTACCACCAATCA | 521 |
| AA741493 | Reverse Primer | GGTCTCTTGCCTTCATCCAGT | 522 |
| NM_001424 | Forward Primer | GCATCGCCTTCTTCATCTTC | 523 |
| NM_001424 | Reverse Primer | CGTAGCTGCCTTCTCTGGTC | 524 |
| AW242920 | Forward Primer | TTCATGCGTGAAAGTGTGAAG | 525 |
| AW242920 | Reverse Primer | TTTGATCAAAGGGTGTCATCAG | 526 |
| W44413 | Forward Primer | GGTAGGGAGCTTCTCAGCAA | 527 |
| W44413 | Reverse Primer | GTTAGCCCAGAGGAGCTCAA | 528 |
| AK021717 | Forward Primer | CACAGAAAACACCCCCACTT | 529 |
| AK021717 | Reverse Primer | ACTGTATGGAGGCCCAGTTG | 530 |

DETAILED DESCRIPTION OF THE INVENTION

The present invention describes the identification of polynucleotides that correlate with drug sensitivity or resistance of untreated cell lines to determine or predict sensitivity of the cells to a drug, compound, or biological agent. These polynucleotides, called marker or predictor polynucleotides herein, can be employed for predicting drug response. The marker polynucleotides have been determined in an in vitro assay employing microarray technology to monitor simultaneously the expression pattern of thousands of discrete polynucleotides in untreated cells, whose sensitivity to compounds or drugs, in particular, compounds that modulate, e.g., inhibit, protein tyrosine kinase or protein tyrosine kinase activity is tested. The protein tyrosine kinases, or activities thereof, associated with response to a drug, compound, or biological agent include, for example, members of the Src family of protein tyrosine kinases, for example, Src, Fgr, Fyn, Yes, Blk, Hck, Lck and Lyn, as well as the Bcr-abl, Jak, PDGFR, c-kit and Eph receptors protein tyrosine kinases. (See, e.g., P. Blume-Jensen and T. Hunter, 2001, "Oncopolynucleotide Kinase Signaling", Nature, 411:355-365).

The assay according to this invention has allowed the identification of the marker polynucleotides, called protein tyrosine kinase biomarkers herein, having expression levels in the cells that are highly correlated with drug sensitivity exhibited by the cells. Such marker polynucleotides encompass the above-listed protein tyrosine kinase-encoding polynucleotides, and serve as useful molecular tools for predicting a response to drugs, compounds, biological agents, chemotherapeutic agents, and the like, preferably those drugs and compounds, and the like, that affect protein tyrosine kinase activity via direct or indirect inhibition or antagonism of the protein tyrosine kinase function or activity.

In its preferred aspect, the present invention describes polynucleotides that correlate with sensitivity or resistance of breast cell lines to treatment with a protein tyrosine kinase inhibitor compound, e.g., BMS-A, as described herein. (FIG. 1 and Table 2). The protein tyrosine kinase inhibitor compound, BMS-A, utilized for identifying the polynucleotide predictor sets of this invention, was described in WO 00/62778, published Oct. 26, 2000, and is hereby incorporated by reference in its entirety. BMS-A has potent inhibitory activity for a number of protein tyrosine kinases, for example, members of the Src family of protein tyrosine kinases, including Src, Fgr, Fyn, Yes, Blk, Hck, Lck and Lyn, as well as the Bcr-abl, Jak, PDGFR, c-kit and Eph receptors protein tyrosine kinases. Specifically, for the BMS-A protein tyrosine kinase inhibitor compound analyzed, the expression of 137 predictor polynucleotides was found to correlate with resistance/sensitivity of the breast cell lines to the compound.

In accordance with the invention, an approach has been discovered in which polynucleotides and combinations of polynucleotides have been identified whose expression pattern, in a subset of cell lines, correlates to and can be used as an in vitro predictor of cellular response to treatment or therapy with one compound, or with a combination or series of compounds, that are known to inhibit or activate the function of a protein, enzyme, or molecule (e.g., a receptor) that is directly or indirectly involved in cell proliferation, cell responses to external stimuli, (such as ligand binding), or signal transduction, e.g., a protein tyrosine kinase. Preferred are antagonists or inhibitors of the function of a given protein, e.g., a tyrosine kinase.

In a preferred aspect, the BMS-A protein tyrosine kinase inhibitor was employed to determine drug sensitivity in a panel of breast cell lines following exposure of the cells to this compound. Some of the cell lines were determined to be resistant to treatment with the inhibitor compound, while others were determined to be sensitive to the inhibitor. (Table 1). A subset of the cell lines examined provided an expression pattern or profile of polynucleotides, and combinations of polynucleotides, that correlated to, and thus serve as a predictor of, a response by the cells to the inhibitor compound, and to compounds having similar modes of action and/or structure. (FIG. 1 and Tables 2 and 4-5).

Such a predictor set of cellular polynucleotide expression patterns correlating with sensitivity or resistance of cells following exposure of the cells to a drug, or a combination of drugs, provides a useful tool for screening a cancer, tumor, or patient test sample before treatment with the drug or a drug combination. The screening technique allows a prediction of cells of a cancer, tumor, or test sample exposed to a drug, or a combination of drugs, based on the polynucleotide expression results of the predictor set, as to whether or not the cancer, tumor, or test sample, and hence a patient harboring the cancer and/or tumor, will or will not respond to treatment with the drug or drug combination. In addition, the predictor polynucleotides or predictor polynucleotide set can also be utilized as described herein for monitoring the progress of disease treatment or therapy in those patients undergoing treatment involving a protein tyrosine kinase, e.g., src tyrosine kinase, inhibitor compound or chemotherapeutic agent for a disease, e.g., breast cancer.

According to a particular embodiment of the present invention, oligonucleotide microarrays were utilized to measure the expression levels of over 44,792 probe sets in a panel of 23 untreated breast cell lines for which the drug sensitivity to the protein tyrosine kinase inhibitor compound was determined. This analysis was performed to determine whether the polynucleotide expression signatures of untreated cells were sufficient for the prediction of chemosensitivity. Data analysis allowed the identification of marker polynucleotides whose expression levels were found to be highly correlated with drug sensitivity. In addition, the treatment of cells with the BMS-A protein tyrosine kinase inhibitor compound also provided polynucleotide expression signatures predictive of sensitivity to the compound. Thus, in one of its embodiments, the present invention provides these polynucleotides, i.e., polynucleotide "markers" or "biomarkers" or "predictors", which show utility in predicting drug response upon treatment or exposure of cells to a drug. In particular, the marker or predictor polynucleotides are protein tyrosine kinase biomarkerspolynucleotides encoding protein tyrosine kinase biomarker proteins/polypeptides, such as a src tyrosine kinase inhibitor biomarker.

The performance of the polynucleotide expression and marker polynucleotide identification analyses embraced by the present invention is described in further detail and without limitation herein below.

IC$_{50}$ Determination and Phenotype Classification Based on Sensitivity of Twenty-Three Breast Cell Lines to Src tyrosine kinase Inhibitor Compounds Twenty-three breast cell lines were treated with a protein tyrosine kinase inhibitor compound (i.e., BMS-A) to determine the individual IC$_{50}$ value. The average IC$_{50}$ values, along with standard deviations, were calculated from 2 to 5 individual determinations for each cell line. As shown in Table 1, a large variation in the IC$_{50}$ values (>1000-fold) was observed for the compound among the twenty-three breast cell lines.

The IC$_{50}$ value for each cell line was log$_{10}$ transformed. The mean of log$_{10}$(IC$_{50}$) across the twenty-three breast cell lines was calculated for the compound. The log$_{10}$(IC$_{50}$) for each cell line was normalized to the mean of log$_{10}$(IC$_{50}$) across the twenty-three breast cell lines for the compound. The cell lines with a log$_{10}$(IC$_{50}$) below the mean of log$_{10}$(IC$_{50}$) were classified as sensitive to the compound, and those with a log$_{10}$(IC$_{50}$) above the mean of log$_{10}$(IC$_{50}$) were classified as resistant. Table 1 presents the resistance/sensitivity classifications of the twenty-three breast cell lines to the BMS-A compound. As observed in Table 1, seven cell lines were classified as sensitive and sixteen cell lines were classified as resistant to the protein tyrosine kinase inhibitor compound.

Identifying Polynucleotides that Significantly Correlated with Drug Resistance/Sensitivity Classification Expression profiling data of 44,792 probe sets represented on the HG-U133 array set for twenty-three untreated breast cell lines were obtained and preprocessed as described in Example 1, Methods. The preprocessed data containing 5322 polynucleotides were analyzed using K-mean Nearest Neighborhood (KNN) algorithm and "signal to noise model" (T. R. Golub et al., 1999, *Science*, 286:531-537) to identify polynucleotides whose expression patterns were strongly correlated with the drug resistance/sensitivity classification (Table 1). An "idealized expression pattern" corresponds to a polynucleotide that is uniformly high in one class (e.g., sensitive) and uniformly low in the other class (e.g., resistant). Initially, a KNN analysis was performed in which a correlation coefficient was obtained for each polynucleotide using "signal to noise model". The correlation coefficient, which is a measure of relative classification separation, is obtained using the following formula:

$$P(g,c) = (\mu 1 - \mu 2)/(\sigma 1 + \sigma 2).$$

In the above formula, for P(g,c), P represents correlation coefficient between expression for gene, g, and the sensitivity/resistance classification, c; µ1 represents the mean polynucleotide expression level of samples in class 1; µ2 represents the mean polynucleotide expression level of samples in class 2; σ1 represents the standard deviation of polynucleotide expression for samples in class 1; and σ2 represents the standard deviation of polynucleotide expression for samples in class 2.

Large values of P(g,c) indicate a strong correlation between polynucleotide expression and resistance/sensitivity classification. When the correlation is compared to that of a random permutation test (randomly assigned classification), a significance measurement p-value is obtained. Then, the polynucleotides can be ranked according to the correlation coefficient obtained from this analysis, with the highest value indicating the best correlation of polynucleotide expression level with the resistance/sensitivity classification to the protein tyrosine kinase inhibitor compound in the twenty-three breast cell lines.

The KNN analysis demonstrated that hundreds of polynucleotides correlated to the drug resistance/sensitivity classification for the compound. Therefore, for greater stringency, three different methods were applied to select a smaller subset of polynucleotides that correlated with the drug resistance/sensitive classification for the compound:

First, a permutation test was performed to calculate the significance of the correlation coefficients obtained in the above-described KNN analysis. 350 polynucleotides whose 'p' value was less than or equal to 0.01 were selected. Second, the Pearson correlation coefficient (a dimensionless index that ranges from −1.0 to 1.0), was calculated, in which the $IC_{50}$ data were considered as a continuous variable and a linear regression model was utilized to correlate polynucleotide expression level with $IC_{50}$ values for the twenty-three breast cell lines. Those polynucleotides with a correlation coefficient greater than 0.35 or less than −0.35 were selected (p<0.05). Finally, Welch t-test was performed, the polynucleotides with p-values equal to or less than 0.05 were selected.

When the three analyses were performed to select polynucleotides correlated with the drug resistance/sensitivity classification for compound BMS-A, the polynucleotide lists from the three analysis methods were obtained and compared. It was observed that there were 168 polynucleotides overlapped from the three analyses. Of these, 32 polynucleotides were redundantly represented more than once on the 168 polynucleotide list, and removed to just leaving one copy per unique gene. Therefore, 137 unique polynucleotides are identified and listed in Table 2. There are 68 polynucleotides highly expressed in the cell lines that were classified as sensitive to BMS-A, while 69 polynucleotides are highly expressed in the cell lines that were classified as resistant to BMS-A. Examples of the polynucleotides include caveolin-1, caveolin-2, and annexin A1 and annexin A2, which are substrates for src tyrosine kinase (M. T. Brown and J. A. Cooper, 1996, *Biochemica et Biophysica Acta,* 1287:121-149). EphA2 and EphB2 are tyrosine kinase receptors, they have diverse roles in carcinopolynucleotidesis (M. Nakamoto and A. D. Bergemann, 2002, *Microscopy Research and Technique* 59:58-67).

Identification of Polynucleotides Modulated by Drug Treatment

To identify polynucleotides regulated by a protein tyrosine kinase inhibitor compound, e.g., BMS-A, 11 breast cell lines (indicated in bold in the Table 1) having an $IC_{50}$ ranging from 0.0055 to 9.5 μM were used in a drug treatment study. Cells were treated with or without the BMS-A compound (0.4 μM) in 0.1% DMSO for 24 hours. Expression profiling was performed, and the data were analyzed using GeneChip® Expression Analysis software MAS 5.0 (Affymetrix, Santa Clara, Calif.). The polynucleotide expression of a cell line treated with drug was compared pair-wisely to the polynucleotide expression of the same cell line without drug treatment. A change in p-value was calculated, indicating an increase, decrease or no change in polynucleotide expression. When the p-value was less than 0.0025, the change was considered to be significant. Analysis was performed for all 11 cell lines to compare the polynucleotide expression with and without drug treatment.

Figures 1, 2:
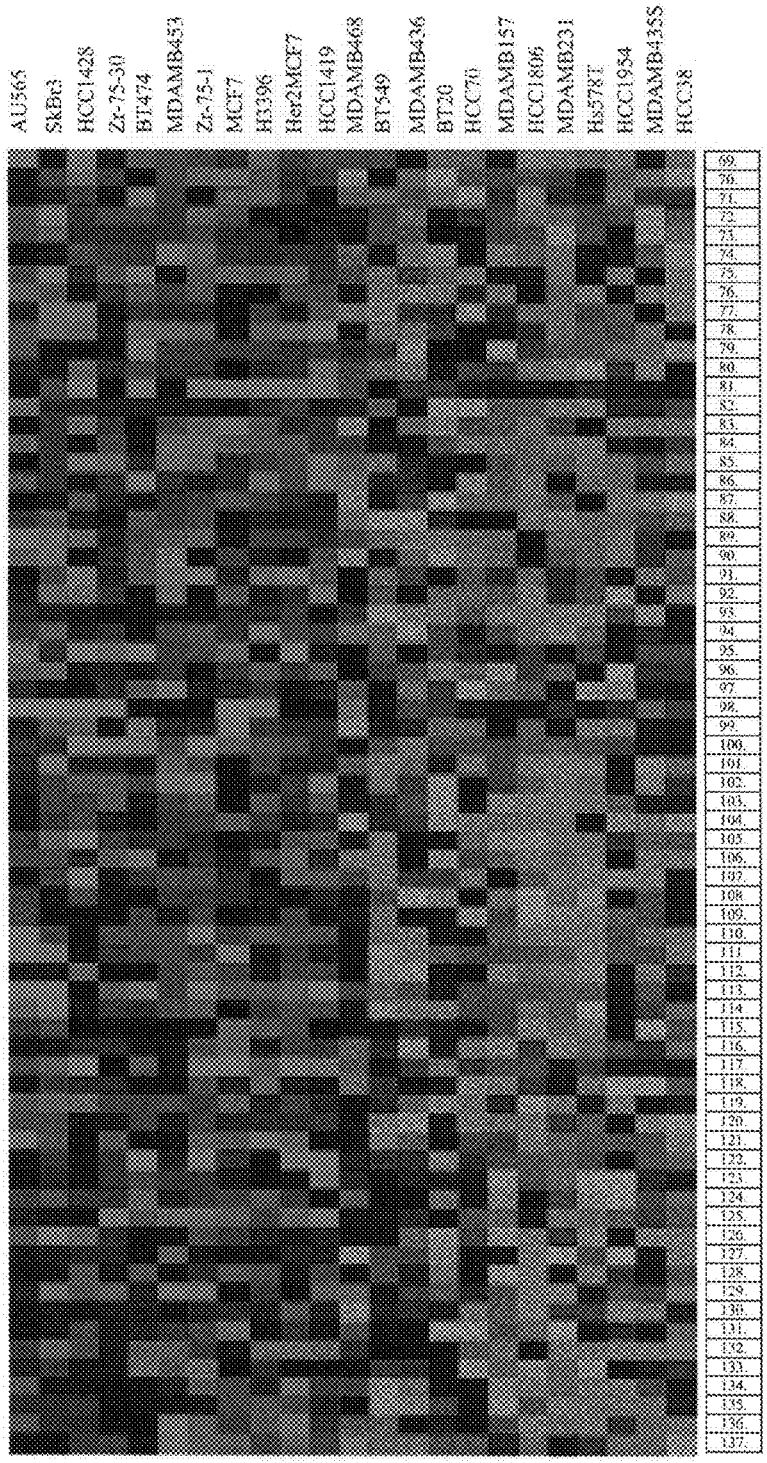
FIG. 2 The examples of polynucleotides whose expression levels are not only correlated with the sensitivity or resistance of breast cell lines to treatment with a protein tyrosine kinase inhibitor compound (e.g., BMS-A), but also differentially down regulated by treatment with the compound. Eleven breast cell lines (5 sensitive and 6 resistant cell lines as indicated in bold in the Table 1) were used in a drug treatment study. Cells were treated with or without the BMS-A compound (0.4 µM) in 0.1% DMSO for 24 hours. Expression profiling was performed, the polynucleotide expression of a cell line treated with drug was compared pair-wisely to the polynucleotide expression of the same cell line without drug treatment. Five sensitive cell lines without drug treatment are indicated with lightly shaded bars ("A" side of graph); five sensitive cell lines with drug treatment are indicated in darkly shaded bars ("A" side of graph); six resistant cell lines without drug treatment are indicated in darkly shaded bars ("B" side of graph); six resistant cell lines with drug treatment are indicated in lightly shaded bars ("B" side of graph).

In addition, a pair-wise t-test with permutation analysis was applied. Polynucleotides that were significantly modulated by the drug treatment in sensitive cell lines and/or in resistant cell lines were identified. Polynucleotides whose expression was significantly changed in at least 3 cell lines were considered to be modulated by the drug. The polynucleotides, whose expression was significantly correlated with drug resistance/sensitivity classification and modulated by drug treatment as well, are indicated in Table 2. Examples of such polynucleotides include EphA2 and caveolin-2, which were highly expressed in sensitive cells and were down regulated by treatment with the protein tyrosine kinase inhibitor compound BMS-A only in sensitive cell lines as shown in FIG. 2.

Figure 3:
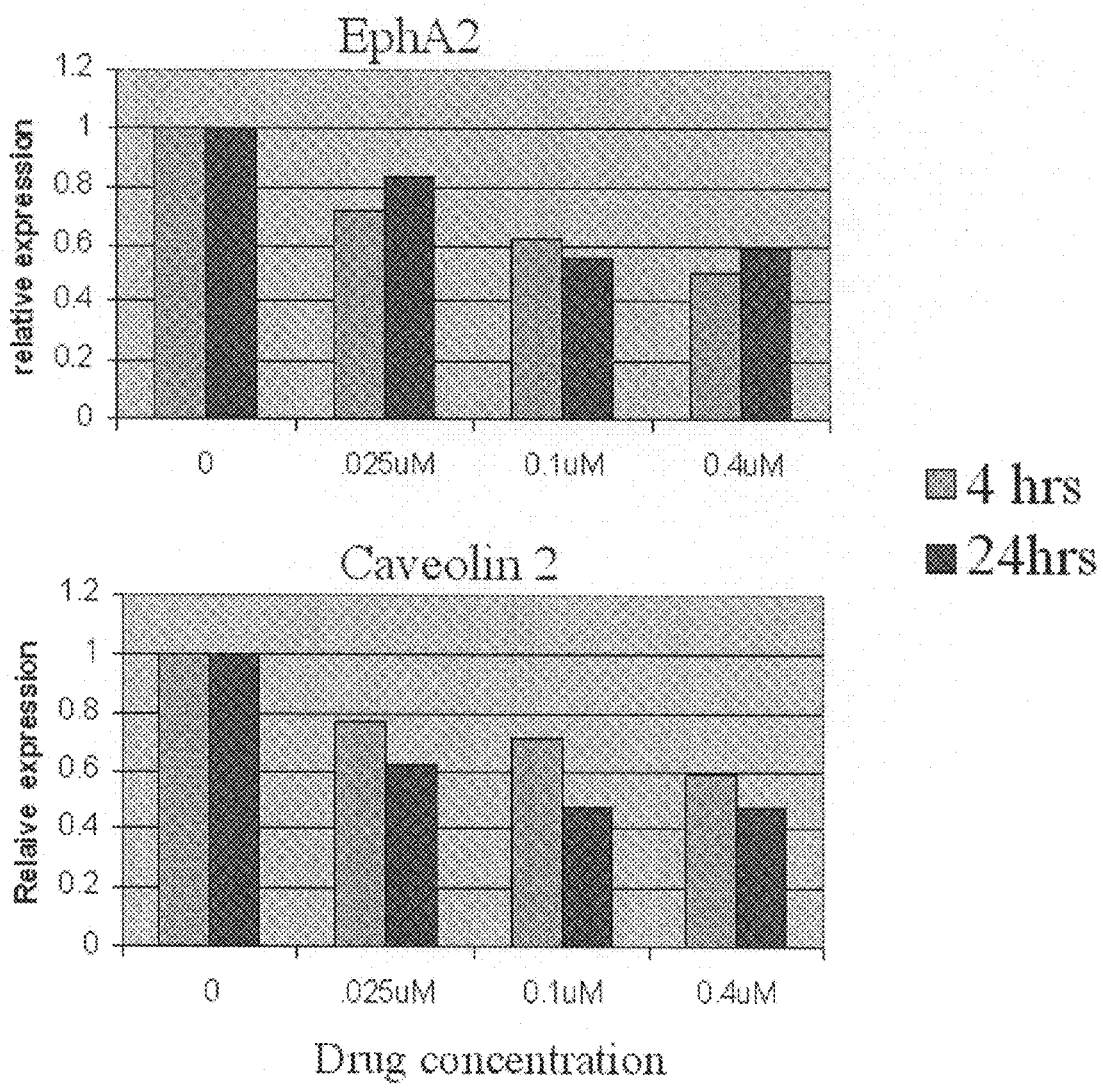
FIG. 3 The examples of polynucleotide whose expression is down regulated by BMS-A compound treatment in a dose and time dependent manner in a prostate cell line PC3. Cells are treated without or with 0.025 µM, 0.1 µM and 0.4 µM of the BMS-A compound for 4 hours or 24 hours. The relative polynucleotide expression level of treated cells is compared to the corresponding untreated control which is set to 1. Drug concentrations and time of treatment are indicated.

Down regulation of the marker polynucleotides by the protein tyrosine kinase inhibitor compound treatment is also seen in PC3 prostate cell line which is tested to be very sensitive to BMS-A. As illustrated in FIG. 3, a dose and time dependent polynucleotide expression decrease of EphA2 and caveolin-2 is observed when compared to the untreated control.

Figure 4:
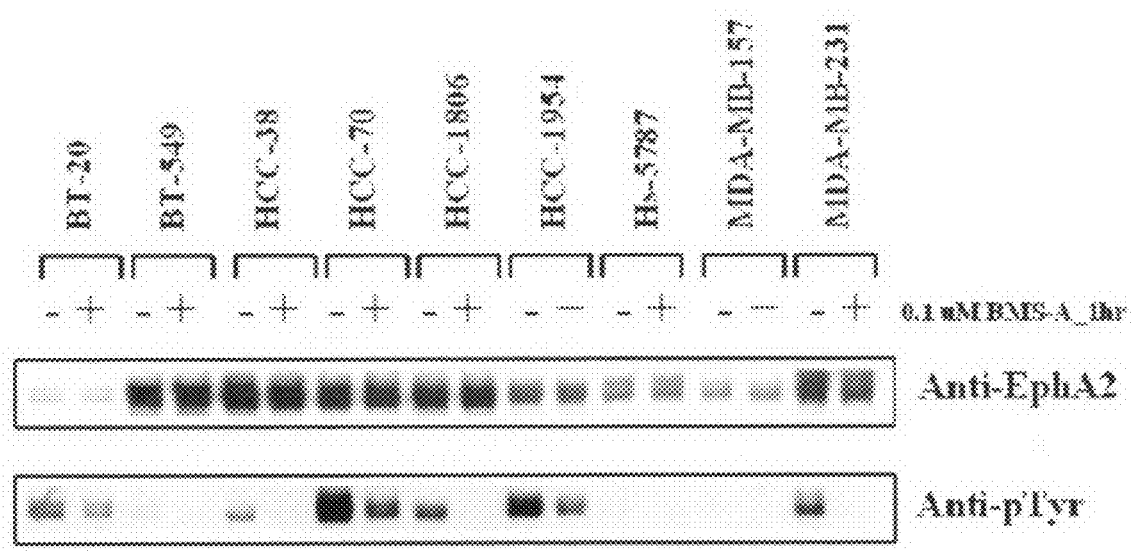
FIG. 4 Immunoblot analysis of EphA2 protein level and tyrosine phosphorylation status in nine breast tumor cell lines. Cells were treated with 0.1 µM BMS-A for 1 hour. Cell lysates were immuno-precipitated with EphA2 antibody and blotted with EphA2 antibody (to assess EphA2 protein level) or anti-phosphotyrosine antibody (to assess EphA2 tyrosine phosphorylation status). Cell lines with or without drug treatment are indicated. The results indicate that EphA2 protein level does not change upon one hour drug treatment, but the phosphorylation of tyrosine residues is dramatically decreased with the drug treatment.

Since EphA2 belongs to family of tyrosine kinase receptors, it is possible to test whether cells treated with the protein tyrosine kinase inhibitor compound BMS-A would affect phosphorylation status of EphA2. Immunoblot analysis of protein level and phosphorylation status of EphA2 in nine breast tumor cell lines is shown in FIG. 4. Cells were treated with 0.1 μM of BMS-A for one hour. Cell lysates were immuno-precipitated with EphA2 antibody and blot with EphA2 antibody or anti-phosphotyrosine antibody. The results indicate that EphA2 protein level does not change upon the drug treatment for one hour, but the phosphorylation at tyrosine residue is dramatically decreased with the drug treatment. Recombinant human EphA2 protein was also tested in an in vitro kinase assay and showed auto dephosphorylation upon the protein tyrosine kinase inhibitor compound BMS-A treatment with an inhibitory $IC_{50}$ of 17 nM.

The identification of those polynucleotides whose expression levels are not only correlated with the sensitivity or resistance of breast cell lines to treatment with a protein tyrosine kinase inhibitor compound (e.g., BMS-A), but also differentially regulated or modified by treatment with the compound can provide additional information about biological function or activity. The expression levels of these polynucleotides are regulated, or their phosphorylation level is modulated by the inhibitor compound indicating these polynucleotides are likely to be directly or indirectly involved in one or more protein tyrosine kinase signaling pathways, for example, protein tyrosine kinases that are members of the Src family of tyrosine kinases, including Src, Fgr, Fyn, Yes, Blk, Hck, Lck and Lyn, as well as other protein tyrosine kinases, including, Bcr-abl, Jak, PDGFR, c-kit and Eph receptors.

Utility of Highly Correlated Polynucleotides to Make Predictions

Polynucleotides that correlate to a specific property of a biological system can be used to make predictions about that biological system and other biological systems. The Genecluster software or other programs can be used to select polynucleotides and combinations of polynucleotides that can predict properties using a "weighted-voting cross-validation algorithm" (T. R. Golub et al., 1999, *Science,* 286:531-537). In particular, the Genecluster software was used to build predictors that demonstrate the utility of polynucleotides that correlate to drug sensitivity and resistance. As used herein, the terms "predictor" or "predictor sets" are used as follows: a predictor or a predictor set refers to a single gene, or combination of polynucleotides, whose expression pattern or properties can be used to make predictions, with different error rates, about a property or characteristic of any given biological system.

The ability of polynucleotide expression patterns to predict a resistance/sensitive classification was further investigated using a "weighted-voting cross-validation algorithm" which uses a leave one out cross-validation strategy as described by T. R. Golub et al., 1999, *Science,* 286:531-537. The program was formatted to select the optimal number of polynucleotides whose expression pattern could be used to predict, with optimal accuracy, the classification of a cell line based on resistance or sensitivity toward a given protein tyrosine kinase inhibitor compound, e.g., BMS-A. A brief description of the cross-validation strategy of the program is described.

Based on the leave-one-out cross-validation strategy, a total of twenty-three prediction analyses (i.e., the number of cell lines in the data set) were performed in an iterative manner and the results of all twenty-three prediction analyses were combined to select the optimal number of polynucleotides that had optimal predictive accuracy. In each separate prediction analysis, one cell line was withheld from the data set, and an optimal number polynucleotide predictor was built, based on the remaining twenty-two cell lines, and was subsequently used to predict the class of the withheld sample.

Figure 5:
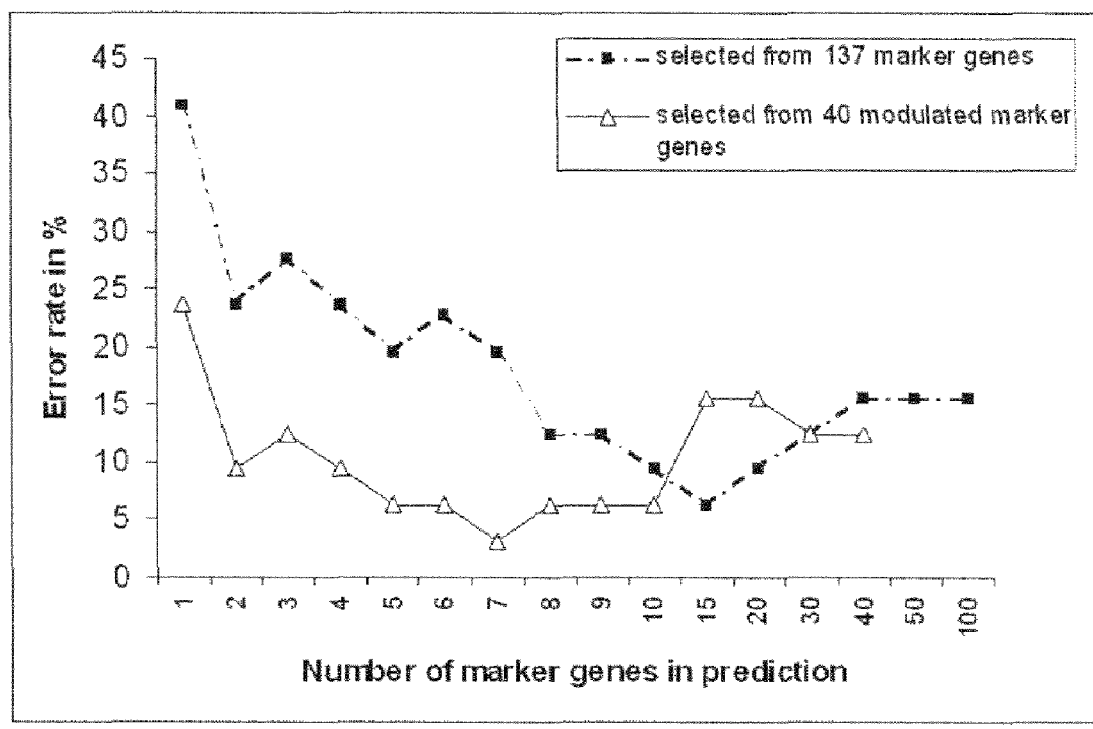
FIG. 5 shows the error rates of different predictor sets comprising the marker polynucleotides with differential selection and combination for the BMS-A protein tyrosine kinase inhibitor compound in the leave-one-out cross validation tests. The Genecluster software was used to select polynucleotides and predict classifications using a "weighted-voting leave-one-out cross-validation algorithm", as described herein. A different number of polynucleotides was selected in the predictor set from (i) the 137 polynucleotides, or (ii) the 40 polynucleotides modulated by BMS-A treatment as shown in Table 2, for predicting resistant and sensitive classes to BMS-A in the breast cell lines.

FIG. 5 shows the real error rates using different numbers of polynucleotides in the predictor set and using different selections and combinations of markers for predicting classes among the breast cell lines which were either resistant or sensitive to BMS-A. When the predictor sets were selected from the 137 polynucleotides as shown in Table 2, the lowest error rate of 6.3% was achieved in the cross-validation tests with 15 markers. Another predictor set comprised of 7 different polynucleotides selected from the 40 polynucleotides that were modulated by the drug treatment achieved an error rate of 3.1%. This result indicates that polynucleotides which are not only correlated with drug sensitivity, but also modulated by drug, can provide a better and more accurate prediction in a predictor set.

Figure 6:
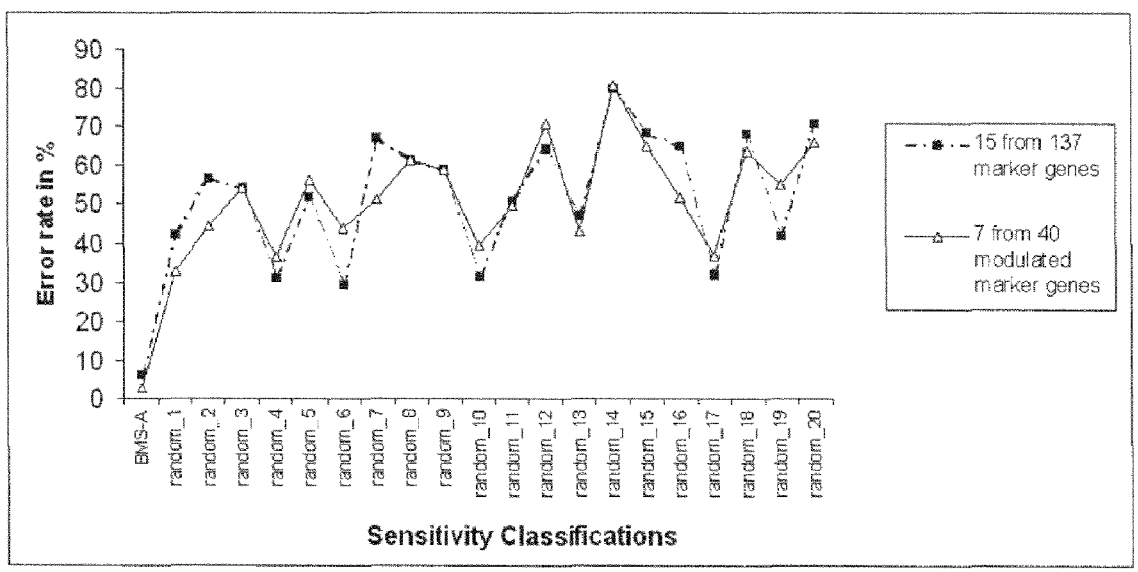
FIG. 6 shows the error rate comparison for predicting the sensitivity classification of compound BMS-A in the breast cell lines and random permutation tests in leave-one-out cross validation. When a predictor set contained either 7 or 15 polynucleotides selected from different polynucleotide groups, the error rate of the leave-one-out cross validation tests for predicting sensitivity of BMS-A in the 23 breast cell lines was 3.1% and 6.3% respectively. In contrast, the real error rates ranged from 30% to 83% when the same number of polynucleotides in a predictor set was used in 20 cases in which classification for the breast cell lines was randomly assigned. This result demonstrates that the error rate value for predicting sensitivity of BMS-A in the 23 breast cell lines is significantly lower than the error rate for predicting sensitivity for the 23 breast cell lines when their classification is randomly assigned in 20 cases.

The real error rates for predicting the sensitivity class of breast cell lines to BMS-A were compared with the real error rates using the same number of polynucleotides as the predictor set in 20 cases in which classification for the breast cell lines was randomly assigned. As shown in FIG. 6, in the cross-validation tests, when the predictor set contained either 7 or 15 polynucleotides selected from different polynucleotide groups, the error rate for predicting sensitivity of BMS-A in the 23 breast cell lines was 3.1% and 6.3%, respectively. By contrast, the real error rates ranged from 30% to 83% when using same number of polynucleotides for the predictor set in 20 cases in which classification for the breast cell lines was randomly assigned. This result demonstrated that the error rate value for predicting sensitivity to BMS-A in 23 breast cell lines was significantly lower than the error rate for predicting randomly assigned classification.

Table 3 shows the prediction accuracy of the optimal 15 and 7 polynucleotide predictor sets for the resistance/sensitive classification of the twenty-three breast cell lines to BMS-A in the leave-one-out cross validation tests. When a 15 polynucleotide predictor set selected from the 137 polynucleotides which were derived from above mentioned three analysis methods (i.e., KNN, Pearson correlation between polynucleotide expression level and $IC_{50}$ values for the twenty-three breast cell lines, and t-test) was used in a leave-one-out cross-validation test, twenty-one out of twenty-three samples were correctly predicted and two resistant cell lines, HCC38 and MDA-MB-435S were predicted to be sensitive to BMS-A. This resulted in a 6.3% real error rate, calculated as follows:

$$\frac{(2/16 \text{ resistant} + 0/7 \text{ sensitive})}{2} \times 100\%$$

When a 7 polynucleotide predictor set, selected from the 40 drug treatment modulated polynucleotides that were part of the 137 polynucleotides in Table 2, was used in a leave-one-out cross-validation test, only one resistant cell line, HCC38, was predicted to be sensitive to BMS-A. This resulted in a 3.1% real error rate, calculated as follows:

$$\frac{(1/16 \text{ resistant} + 0/7 \text{ sensitive})}{2} \times 100\%$$

In addition, a Prediction Strength ("PS") score for each prediction made on a cell line by the predictor set can be obtained from the Genecluster software. The "PS" score ranges from 0 to 1, measuring the margin of victory in each prediction using weighted-voting cross-validation algorithm (see, e.g., T. R. Golub et al., 1999, Science, 286:531-537). The higher the value of a PS score is, the more confident the prediction make. The PS score values for each cell line using the optimal 15 or 7 polynucleotide predictor set, obtained as described above for BMS-A, are shown in Table 3. Note that even though the cell line BT549 was predicted correct to be resistant with both the 15 and 7 polynucleotide predictor sets, the PS score was very low, which means the confidence of prediction is low.

It will be appreciated that the exact number of polynucleotides that should comprise an optimal predictor set is not particularly established or defined. It is unlikely in the real world that any predictor set can be obtained with 100% or absolute accuracy. This is due to the fact that there is a trade-off between the amount of additional information and robustness that are gained by adding more polynucleotides, and the amount of noise that is concomitantly added. In accordance with the present invention, different numbers of polynucleotides were tested in the predictor sets; data were obtained and analyzed for a protein tyrosine kinase inhibitor, BMS-A. The selection of marker polynucleotides for use in the prediction set was well within the total number of polynucleotides, as shown in Table 2, that strongly correlated with the sensitivity class distinction.

Thus, in accordance with the present invention, an approach has been developed in which polynucleotides and combinations of polynucleotides have been discovered whose expression pattern in a subset of cell lines correlates with, and can be used as a predictor of, response to treatment with compounds that inhibit the function of protein tyrosine kinases.

Predictor Sets, Error Rates and Algorithms Used to Demonstrate Utility

The number of polynucleotides in any given predictor or predictor set may influence the error rate of the predictor set in cross validation experiments and with other mathematical algorithms. The data show that the error rate of a predictor is somewhat dependent on the number of polynucleotides in the predictor set and the contribution of each individual polynucleotide in the given predictor set and the number of cell lines that are tested in the cross validation experiment. For example, in a given predictor set, one polynucleotide may contribute more significantly than other polynucleotides to the prediction.

It is very likely that if a polynucleotide significantly contributes to a predictor set, then it can be used in different combinations with other polynucleotides to achieve different error rates in different predictor sets. For example, polynucleotide A alone gives an error rate of 30%. In combination with polynucleotides, B, C and D, the error rate becomes 10%; in combination with polynucleotides B, D and E, the error rate becomes 12%; while a combination of polynucleotide A with polynucleotides E-X gives an error rate of 8%, and so on. As demonstrated in FIG. 5, different selection and combination of polynucleotides in a predictor set achieve different error rates in the cross-validation tests.

When the predictor sets were selected from the 137 polynucleotides as shown in Table 2, the lowest error rate of 6.3% was achieved in the cross-validation test with 15 markers as shown in Table 4. Another predictor set comprised of 7 polynucleotides (Table 5) selected from the 40 polynucleotides that were modulated by the drug treatment, achieved an error rate of 3.1%. This result indicates that polynucleotides which are not only correlated with drug sensitivity, but also modulated by the drug, can provide a better and more accurate prediction in a predictor set.

The error rates as described herein apply to the set of cell lines used in the cross-validation experiment. If a different set is used, or more cell lines are added to the original set tested, then different error rates may be obtained as described and understood by the skilled practitioner. Importantly, different combinations of polynucleotides that correlate to drug sensitivity can be used to build predictors with different prediction accuracy.

Figures 1, 7:
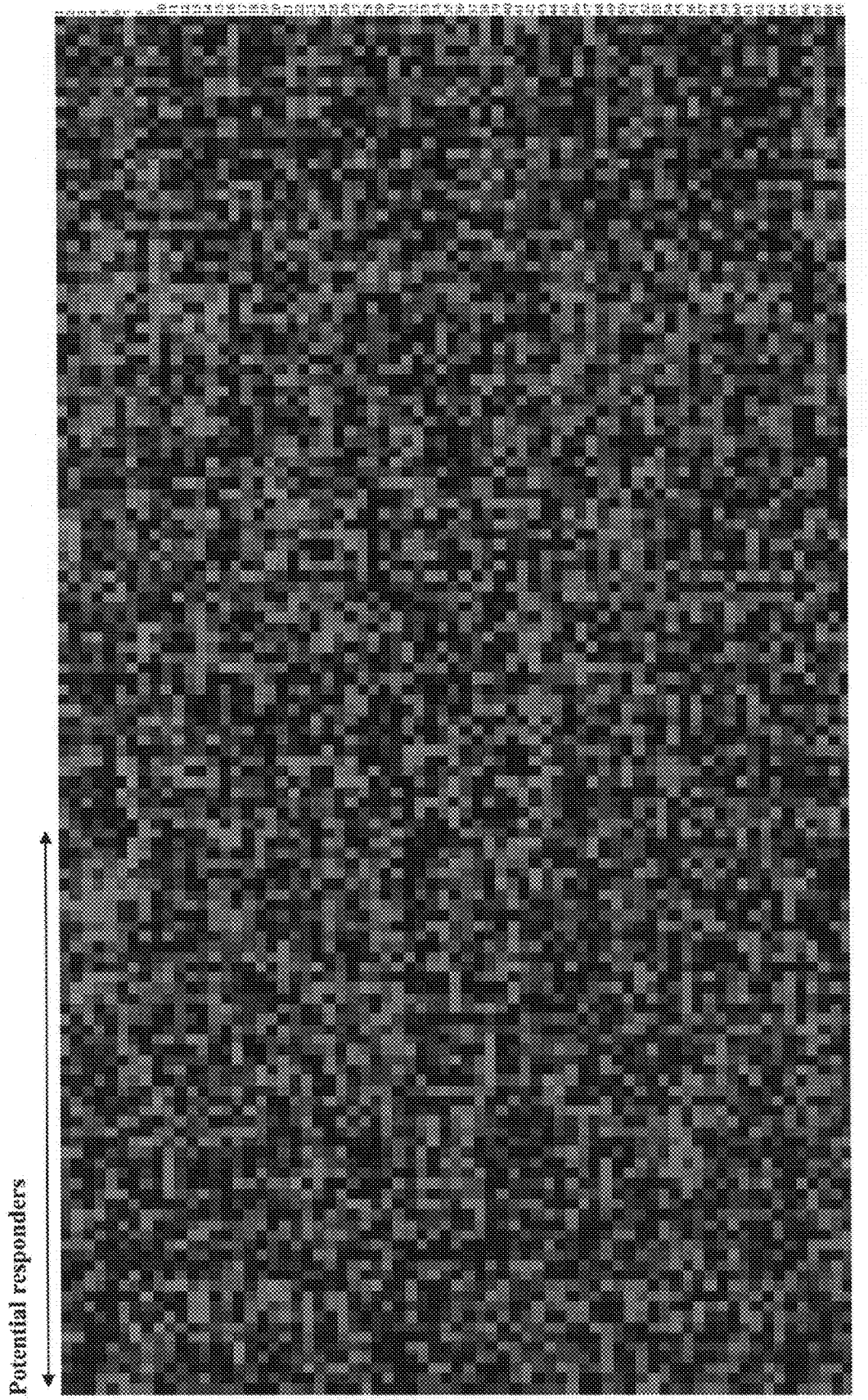
FIG. 7 The expression pattern of the 137 marker polynucleotides in 134 primary breast tumors. These 137 polynucleotides are highly correlated with a resistance/sensitivity phenotype classification of the 23 breast cell lines for the protein tyrosine kinase inhibitor compound BMS-A according to the present invention (as shown in FIG. 1). Each row corresponds to a gene, with the columns corresponding to expression level in the different breast tumor samples. Expression levels for each polynucleotide were normalized across all 134 breast tumor samples such that the median is 0 and the standard derivation is 1. The expression levels greater than the median are shaded in red, those below the mean are shaded in green, while those at the mean are shaded in black. The order of individual polynucleotides encoding the protein tyrosine kinase biomarkers of the invention are the same as indicated in FIG. 1. The expression pattern clearly shows that a group of primary breast tumors (as indicated by the arrow) highly expressed sensitive markers of protein tyrosine kinase inhibitor compound of the invention. By contrast, another different group highly expressed resistant markers.
Figures 2, 7:
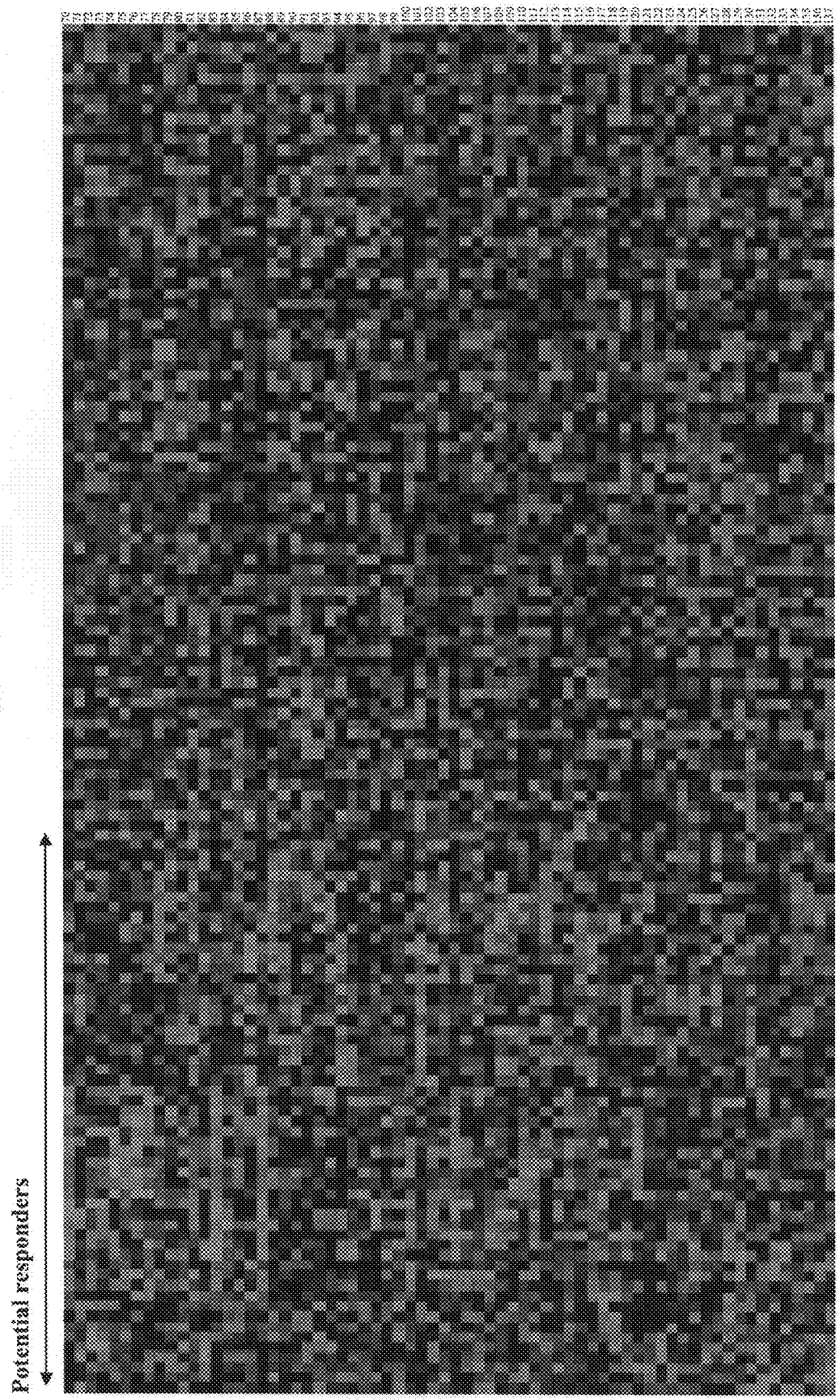

Expression Pattern of the Protein Tyrosine Kinase Biomarkers in Primary Breast Tumors One hundred thirty-four primary breast tumor biopsies were obtained from clinic, and expression profiles of these samples were performed. The expression pattern of the 137 polynucleotides, that are highly correlated with a resistance/sensitivity phenotype classification of the 23 breast cell lines for the protein tyrosine kinase inhibitor compound BMS-A according to the present invention (as shown in FIG. 1 and Table 2), were examined in the 134 primary breast tumors as demonstrated in FIG. 7. Each row corresponds to a gene, with the columns corresponding to expression level in the different breast tumor samples. The individual polynucleotide encoding the protein tyrosine kinase biomarkers of the invention is in the same order as indicated in FIG. 1. It is clear as shown in FIG. 7 that a group of primary breast tumors (as indicated by the arrow) highly express the sensitive biomarkers of protein tyrosine kinase inhibitor of the invention. By contrast, another different group primary breast tumors highly express the resistant biomarkers. Although, whether these group of primary breast tumors highly expressing the sensitive biomarkers are really sensitive to the protein tyrosine kinase compounds, e.g., BMS-A is unknown and need to be tested, the fact that the primary breast tumors exist similar expression pattern of the protein tyrosine kinase biomarkers as the sensitive breast cell lines gives a promise clue.

Applications of Predictor Sets

Predictor sets with different error rates can be used in different applications. Predictor sets can be built from any combination of the polynucleotides listed in Table 2, or the predictor polynucleotide subsets of 15 and 7 polynucleotides, as presented in each of Tables 4 and 5, respectively, to make predictions about the likely effect of protein tyrosine modulator compounds, e.g., inhibitors, or compounds that affect a protein tyrosine kinase signaling pathway in different biological systems. The various predictor sets described herein, or the combination of these predictor sets with other polynucleotides or other co-variants of these polynucleotides, can have broad utility. For example, the predictor sets can be used as diagnostic or prognostic indicators in disease management; they can be used to predict how patients with cancer might respond to therapeutic intervention with compounds that modulate the protein tyrosine kinase family (e.g., the src tyrosine kinase family); and they can be used to predict how patients might respond to therapeutic intervention that modulate signaling through an entire protein tyrosine kinase regulatory pathway, such as, for example, the src tyrosine kinase regulatory pathway.

While the data described herein were generated in cell lines that are routinely used to screen for and identify compounds that have potential utility for cancer therapy, the predictors can have both diagnostic and prognostic value in other diseases areas in which signaling through a protein tyrosine kinase or a protein tyrosine kinase pathway is of importance, e.g., in immunology, or in cancers or tumors in which cell signaling and/or proliferation controls have gone awry. Such protein tyrosine kinases and their pathways comprise, for example, members of the Src family of tyrosine kinases, for example, Src, Fgr, Fyn, Yes, Blk, Hck, Lck and Lyn, as well as other protein tyrosine kinases, including, Bcr-abl, Jak, PDGFR, c-kit and Eph receptors. Although the data described herein have been generated using the particularly exemplified protein tyrosine kinase inhibitor compound, BMS-A, three other protein tyrosine kinase inhibitor compounds were tested in addition to BMS-A and were found to have similar sensitivity and resistance classifications in the 23 breast cell lines evaluated. Thus, the predictors can have both diagnostic and prognostic value related to other inhibitor molecules, as well as any molecules or therapeutic interventions that affect protein tyrosine kinases, such as Src tyrosine kinase, or a protein tyrosine kinase signaling pathways, such as that of the Src tyrosine kinase.

Those having skill in the pertinent art will appreciate that protein tyrosine kinase pathways, e.g., the Src tyrosine kinase pathway, are present and functional in cell types other than cell lines of breast tissue. Therefore, the described predictor set of polynucleotides, or combinations of polynucleotides within the predictor set, can show utility for predicting drug sensitivity or resistance to compounds that interact with, or inhibit, a protein tyrosine kinase activity in cells from other tissues or organs associated with a disease state, or cancers or tumors derived from other tissue or organ types. Non-limiting examples of such cells, tissues and organs include colon, breast, lung, heart, prostate, testes, ovaries, cervix, esophagus, pancreas, spleen, liver, kidney, intestine, stomach, lymphocytic and brain, thereby providing a broad and advantageous applicability to the predictor polynucleotide sets described herein. Cells for analysis can be obtained by conventional procedures as known in the art, for example, tissue or organ biopsy, aspiration, sloughed cells, e.g., colonocytes, clinical or medical tissue, or cell sampling procedures.

Functionality of Polynucleotides that Make Up a Predictor Set

The use of a predictor, or predictor set, (e.g., predictor polynucleotides, or a predictor set of polynucleotides) allows for the prediction of an outcome prior to having any knowledge about a biological system. Essentially, a predictor can be considered to be a tool that is useful in predicting the phenotype that is used to classify the biological system. In the specific embodiment provided by the present invention, the classification as "resistant" or "sensitive" is based on the $IC_{50}$ value of each cell line to a compound (e.g., the protein tyrosine kinase inhibitor compound BMS-A as exemplified herein), relative to the mean $\log_{10}(IC_{50})$ value of the cell line panel (e.g., a twenty-three breast cell line panel, as exemplified herein).

As a particular example, a number of the polynucleotides described herein (Table 2) are known to be substrates for the src tyrosine kinase family, e.g., caveolin-1 and caveolin-2 (M. T. Brown and J. A. Cooper, 1996, *Biochemica et Biophysica Acta*, 1287:121-149). EphA2 is a tyrosine kinase receptor. The data presented herein demonstrated that EphA2 is highly expressed in the sensitive cell lines, and its expression level and activity are down regulated by treatment of the protein tyrosine kinase inhibitor compound BMS-A. This is expected, since polynucleotides that contribute to a high predictor accuracy are likely to play a functional role in the pathway that is being modulated. For example, Herceptin therapy (i.e., antibody that binds to the Her2 receptor and prevents function via internalization) is indicated when the Her2 polynucleotide is overexpressed. It is unlikely, although not impossible, that a therapy will have a therapeutic effect if the target enzyme is not expressed.

However, although the complete function of all of the polynucleotides and their functional products (proteins and mRNAs) that make up a predictor set are not currently known, some of the polynucleotides are likely to be directly or indirectly involved in a protein tyrosine kinase signaling pathway, such as the Src tyrosine kinase signaling pathway. In addition, some of the polynucleotides in the predictor set may function in the metabolic or other resistance pathways specific to the compounds being tested. Notwithstanding, a knowledge about the function of the polynucleotides is not a requisite for determining the accuracy of a predictor according to the practice of the present invention.

As described herein, polynucleotides have been discovered that correlate to the relative intrinsic sensitivity or resistance of breast cell lines to treatment with compounds that interact with and inhibit protein tyrosine kinases, e.g., Src tyrosine kinase. These polynucleotides have been shown, through a weighted voting, leave-one-out, cross validation program, to have utility in predicting the intrinsic resistance and sensitivity of breast cell lines to these compounds.

An embodiment of the present invention relates to a method of determining or predicting if an individual requiring drug or chemotherapeutic treatment or therapy for a disease, for example, a breast cancer or a breast tumor, will be likely to successfully respond or not respond to the drug or chemotherapeutic agent prior to subjecting the individual to such treatment or chemotherapy. The drug or chemotherapeutic agent can be one that modulates a protein tyrosine kinase activity or signaling involving a protein tyrosine kinase. Non-limiting examples of such protein tyrosine kinases include members of the Src family of tyrosine kinases, for example, Src, Fgr, Fyn, Yes, Blk, Hck, Lck and Lyn, as well as other protein tyrosine kinases, including, Bcr-abl, Jak, PDGFR, c-kit and Eph receptors. In accordance with the method of the invention, cells from a tissue or organ associated with disease, e.g., a patient biopsy of a tumor or cancer, preferably a breast cancer or tumor biopsy, are subjected to an in vitro assay as described herein, to determine their marker polynucleotide expression pattern (polynucleotides from Table 2 and/or the predictor polynucleotide subsets of Tables 4-5) prior to their treatment with the compound or drug, preferably an inhibitor of a protein tyrosine kinase. The resulting polynucleotide expression profile of the cells before drug treatment is compared with the polynucleotide expression pattern of the same polynucleotides in cells that are either resistant or sensitive to the drug or compound, as provided by the present invention.

In another related embodiment, the present invention includes a method of predicting, prognosing, diagnosing, and/or determining whether an individual requiring drug therapy for a disease state or chemotherapeutic for cancer (e.g., breast cancer) will or will not respond to treatment prior to administration of treatment. The treatment or therapy preferably involves a protein tyrosine kinase modulating agent, compound, or drug, for example, an inhibitor of the protein tyrosine kinase activity. Protein tyrosine kinases include, without limitation, members of the Src family of tyrosine kinases, for example, Src, Fgr, Fyn, Yes, Blk, Hck, Lck and Lyn, as well as other protein tyrosine kinases, including, Bcr-abl, Jak, PDGFR, c-kit and Eph receptors. Preferred is src tyrosine kinase and inhibitors thereof. In accordance with this embodiment, cells from a patient's tissue sample, e.g., a breast tumor or cancer biopsy, are assayed to determine their polynucleotide expression pattern prior to treatment with the protein tyrosine kinase modulating agent, compound, or drug. The resulting polynucleotide expression profile of the test cells before exposure to the compound or drug is compared with that of one or more of the predictor subsets of polynucleotides comprising either 15 or 7 polynucleotides as described herein and shown in Tables 4-5, respectively.

Success or failure of treatment of a patient's cancer or tumor with the drug can be determined based on the polynucleotide expression pattern of the patient's cells being tested, compared with the polynucleotide expression pattern of the predictor polynucleotides in the resistant or sensitive panel of that have been exposed to the drug or compound and subjected to the predictor polynucleotide analysis detailed herein. Thus, if following exposure to the drug, the test cells show a polynucleotide expression pattern corresponding to that of the predictor polynucleotide set of the control panel of cells that is sensitive to the drug or compound, it is highly likely or predicted that the individual's cancer or tumor will respond favorably to treatment with the drug or compound. By contrast, if, after drug exposure, the test cells show a polynucleotide expression pattern corresponding to that of the predictor polynucleotide set of the control panel of cells that is resistant to the drug or compound, it is highly likely or predicted that the individual's cancer or tumor will not respond to treatment with the drug or compound.

In a related embodiment, screening assays are provided for determining if a patient's cancer or tumor is or will be susceptible or resistant to treatment with a drug or compound, particularly, a drug or compound directly or indirectly involved in protein tyrosine kinase activity or a protein tyrosine kinase pathway, e.g., the Src tyrosine kinase activity or pathway.

Also provided by the present invention are monitoring assays to monitor the progress of a drug treatment involving drugs or compounds that interact with or inhibit protein tyrosine kinase activity. Protein tyrosine kinases encompassed by these monitoring assays include members of the Src family of tyrosine kinases, for example, Src, Fgr, Fyn, Yes, Blk, Hck, Lck and Lyn, as well as other protein tyrosine kinases, including, Bcr-abl, Jak, PDGFR, c-kit and Eph receptors. Such in vitro assays are capable of monitoring the treatment of a patient having a disease treatable by a compound or agent that modulates or interacts with a protein tyrosine kinase by comparing the resistance or sensitivity polynucleotide expression pattern of cells from a patient tissue sample, e.g., a tumor or cancer biopsy, preferably a breast cancer or tumor sample, prior to treatment with a drug or compound that inhibits the protein tyrosine kinase activity and again following treatment with the drug or compound with the expression pattern of one or more of the predictor polynucleotide sets described, or combinations thereof. Isolated cells from the patient are assayed to determine their polynucleotide expression pattern before and after exposure to a compound or drug, preferably a protein tyrosine kinase inhibitor, to determine if a change of the polynucleotide expression profile has occurred so as to warrant treatment with another drug or agent, or discontinuing current treatment. The resulting polynucleotide expression profile of the cells tested before and after treatment is compared with the polynucleotide expression pattern of the predictor set of polynucleotides that have been described and shown herein to be highly expressed in cells that are either resistant or sensitive to the drug or compound. Alternatively, a patient's progress related to drug treatment or therapy can be monitored by obtaining a polynucleotide expression profile as described above, only after the patient has undergone treatment with a given drug or therapeutic compound. In this way, there is no need to test a patient sample prior to treatment with the drug or compound.

Such a monitoring process can indicate success or failure of a patient's treatment with a drug or compound based on the polynucleotide expression pattern of the cells isolated from the patient's sample, e.g., a tumor or cancer biopsy, as being relatively the same as or different from the polynucleotide expression pattern of the predictor polynucleotide set of the resistant or sensitive control panel of cells that have been exposed to the drug or compound and assessed for their polynucleotide expression profile following exposure. Thus, if, after treatment with a drug or compound, the test cells show a change in their polynucleotide expression profile from that seen prior to treatment to one which corresponds to that of the predictor polynucleotide set of the control panel of cells that are resistant to the drug or compound, it can serve as an indicator that the current treatment should be modified, changed, or even discontinued. Also, should a patient's response be one that shows sensitivity to treatment by a protein tyrosine kinase inhibitor compound, e.g., a Src tyrosine kinase inhibitor, based on correlation of the expression profile of the predictor polynucleotides of cells showing drug sensitivity with the polynucleotide expression profile from cells from a patient undergoing treatment, the patient's treatment prognosis can be qualified as favorable and treatment can continue. Further, if a patient has not been tested prior to drug treatment, the results obtained after treatment can be used to determine the resistance or sensitivity of the cells to the drug based on the polynucleotide expression profile compared with the predictor polynucleotide set.

In a related embodiment, the present invention embraces a method of monitoring the treatment of a patient having a disease treatable by a compound or agent that modulates a protein tyrosine kinase, i.e., breast cancer. Protein tyrosine kinases encompassed by such treatment monitoring assays include members of the Src family of tyrosine kinases, for example, Src, Fgr, Fyn, Yes, Blk, Hck, Lck and Lyn, as well as other protein tyrosine kinases, including, Bcr-abl, Jak, PDGFR, c-kit and Eph receptors. For these assays, test cells from the patient are assayed to determine their polynucleotide expression pattern before and after exposure to a protein tyrosine kinase inhibitor compound or drug. The resulting polynucleotide expression profile of the cells tested before and after treatment is compared with the polynucleotide expression pattern of the predictor set of polynucleotides that have been described and shown herein to be highly expressed in cells that are either resistant or sensitive to the drug or compound. Thus, if a patient's response is or becomes one that is sensitive to treatment by a protein tyrosine kinase inhibitor compound, based on correlation of the expression profile of the predictor polynucleotides, the patient's treatment prognosis can be qualified as favorable and treatment can continue. Also, if after treatment with a drug or compound, the test cells do not exhibit a change in their polynucleotide expression profile to a profile that corresponds to that of the control panel of cells that are sensitive to the drug or compound, this serves as an indicator that the current treatment should be modified, changed, or even discontinued. Such monitoring processes can be repeated as necessary or desired and can indicate success or failure of a patient's treatment with a drug or compound, based on the polynucleotide expression pattern of the cells isolated from the patient's sample. The monitoring of a patient's response to a given drug treatment can also involve testing the patient's cells in the assay as described, only after treatment, rather than before and after treatment, with drug or active compound.

In a preferred embodiment, the present invention embraces a method of monitoring the treatment of a patient having a disease treatable by a compound or agent that modulates a src tyrosine kinase, i.e., breast cancer. The test cells from the patient are assayed to determine their polynucleotide expression pattern before and after exposure to a src tyrosine kinase inhibitor compound or drug. The resulting polynucleotide expression profile of the cells tested before and after treatment is compared with the polynucleotide expression pattern of the predictor set of polynucleotides that have been described and shown herein to be highly expressed in cells that are either resistant or sensitive to the drug or compound. Thus, if a patient's response is or becomes one that is sensitive to treatment by a src tyrosine kinase inhibitor compound, based on correlation of the expression profile of the predictor polynucleotides, the patient's treatment prognosis can be qualified as favorable and treatment can continue. Also, if after treatment with a drug or compound, the test cells do not exhibit a change in their polynucleotide expression profile to a profile that corresponds to that of the control panel of cells that are sensitive to the drug or compound, this serves as an indicator that the current treatment should be modified, changed, or even discontinued. Such monitoring processes can be repeated as necessary or desired and can indicate success or failure of a patient's treatment with a drug or compound, based on the polynucleotide expression pattern of the cells isolated from the patient's sample. The monitoring of a patient's response to a given drug treatment can also involve testing the patient's cells in the assay as described only after treatment, rather than before and after treatment, with drug or active compound.

In another embodiment, the present invention encompasses a method of classifying whether a biological system, preferably cells from a tissue, organ, tumor or cancer of an afflicted individual, will be resistant or sensitive to a compound that modulates the system. In a preferred aspect of this invention, the sensitivity or resistance of cells, e.g., those obtained from a tumor or cancer, to a protein tyrosine kinase inhibitor compound, or series of compounds, e.g., a Src tyrosine kinase inhibitor, is determined. Inhibitors can include those compounds, drugs, or biological agents that inhibit, either directly or indirectly, the protein tyrosine kinases as described previously hereinabove. According to the method, a resistance/sensitivity profile of the cells after exposure to the protein tyrosine kinase inhibitor drug or compound can be determined via polynucleotide expression profiling protocols set forth herein. Such resistance/sensitivity profile of the cells reflects an $IC_{50}$ value of the cells to the compound(s) as determined using a suitable assay, such as an in vitro cytotoxicity assay as described in Example 1. A procedure of this sort can be performed using a variety of cell types and compounds that interact with the protein tyrosine kinase, or affect its activity in the signaling pathway of the protein tyrosine kinase.

In another of its embodiments, the present invention includes the preparation of one or more specialized microarrays (e.g., oligonucleotide microarrays or cDNA microarrays) comprising all of the polynucleotides in Tables 2, 4, or 5, or combinations thereof, of the predictor polynucleotide sets described herein that have been demonstrated to be most highly correlated with sensitivity (or resistance) to protein tyrosine kinase modulators, particularly inhibitors of src tyrosine kinase. Preferably, the predictor polynucleotide sets are common for predicting sensitivity among more than one protein tyrosine kinase modulator, e.g. a protein tyrosine kinase inhibitor such as a Src tyrosine kinase inhibitor, as demonstrated herein. In accordance with this aspect of the invention, the oligonucleotide sequences or cDNA sequences include any of the predictor polynucleotides or polynucleotide combinations as described herein, which are highly expressed in resistant or sensitive cells, and are contained on a microarray, e.g., a oligonucleotide microarray or cDNA microarray in association with, or introduced onto, any supporting material, such as glass slides, nylon membrane filters, glass or polymer beads, chips, plates, or other types of suitable substrate material.

Cellular nucleic acid, e.g., RNA, is isolated either from cells undergoing testing after exposure to a drug or compound that interacts with a protein tyrosine kinase as described herein, or its signaling pathway, or from cells being tested to obtain an initial determination or prediction of the cells' sensitivity to the drug or compound, and, ultimately, a prediction of treatment outcome with the drug or compound. The isolated nucleic acid is appropriately labeled and applied to one or more of the specialized microarrays. The resulting pattern of polynucleotide expression on the specialized microarray is analyzed as described herein and known in the art. A pattern of polynucleotide expression correlating with either sensitivity or resistance to the drug or compound is able to be determined, e.g., via comparison with the polynucleotide expression pattern as shown in FIG. 1 for the panel of cells exposed to the protein tyrosine kinase inhibitor assayed herein.

In accordance with the specialized microarray embodiment of this invention, the microarray contains the polynucleotides of one or more of the predictor polynucleotide set(s) or subset(s), or a combination thereof, or all of the polynucleotides in Tables 2, 4, or 5, that are highly correlated with drug sensitivity or resistance by a breast cell type. If the nucleic acid target isolated from test cells, such as tumor or cancer cells, preferably breast cancer or tumor cells, shows a high level of detectable binding to the polynucleotides of the predictor set for drug sensitivity relative to control, then it can be predicted that a patient's cells will respond to the drug, or a series of drugs, and that the patient's response to the drug, or a series of drugs, will be favorable.

Such a result predicts that the cells of a tumor or cancer are good candidates for the successful treatment or therapy utilizing the drug, or series of drugs. Alternatively, if the nucleic acid target isolated from test cells shows a high level of detectable binding to the polynucleotides of the predictor set for drug resistance, relative to control, then it can be predicted that a patient is likely not to respond to the drug, or a series of drugs, and that the patient's response to the drug, or a series of drugs, is not likely to be favorable. Such a result predicts that the cells of a tumor or cancer are not good candidates for treatment or therapy utilizing the drug, or series of drugs.

The utilization of microarray technology is known and practiced in the art. Briefly, to determine polynucleotide expression using microarray technology, polynucleotides, e.g., RNA, DNA, cDNA, preferably RNA, are isolated from a biological sample, e.g., cells, as described herein for breast cells, using procedures and techniques that are practiced in the art. The isolated nucleic acid is detectably labeled, e.g., fluorescent, enzyme, radionuclide, or chemiluminescent label, and applied to a microarray, e.g., the specialized microarrays provided by this invention. The array is then washed to remove unbound material and visualized by staining or fluorescence, or other means known in the art depending on the type of label utilized.

In another embodiment of this invention, the predictor polynucleotides (Table 2), or one or more subsets of polynucleotides comprising the predictor polynucleotide sets (e.g., Tables 4-5) can be used as biomarkers for cells that are resistant or sensitive to protein tyrosine kinase inhibitor compounds, e.g., Src tyrosine kinase inhibitors. With the predictor polynucleotides in hand, screening and detection assays can be carried out to determine whether or not a given compound, preferably a protein tyrosine kinase inhibitor compound such as a Src tyrosine kinase inhibitor compound, elicits a sensitive or a resistant phenotype following exposure of cells, e.g., cells taken from a tumor or cancer biopsy sample, such as a breast cancer cell sample, to the compound. Thus, methods of screening, monitoring, detecting, prognosing and/or diagnosing to determine the resistance or sensitivity of cells to a drug or compound that interacts with a protein tyrosine kinase, or a protein tyrosine kinase pathway, preferably an inhibitor compound, and to which the cells are exposed, are encompassed by the present invention.

Such methods embrace a variety of procedures and assays to determine and assess the expression of polynucleotides, in particular, the predictor or src biomarker polynucleotides and predictor polynucleotide subsets as described herein (Tables 2, 4, and 5), in cells that have been exposed to drugs or compounds that interact with or effect a protein tyrosine kinase, or a protein tyrosine kinase pathway, wherein the protein tyrosine kinases include members of the Src family of tyrosine kinases, for example, Src, Fgr, Fyn, Yes, Blk, Hck, Lck and Lyn, as well as other protein tyrosine kinases, including, Bcr-abl, Jak, PDGFR, c-kit and Eph receptors. Suitable methods include detection and evaluation of polynucleotide activation or expression at the level of nucleic acid, e.g., DNA, RNA, mRNA, and detection and evaluation of encoded protein. For example, PCR assays as known and practiced in the art can be employed to quantify RNA or DNA in cells being assayed for susceptibility to drug treatment, for example, protein tyrosine kinase inhibitors. (see Example 2, RT-PCR).

In another embodiment, the present invention is directed to a method of identifying cells, tissues, and/or patients that are predicted to be resistant to either protein tyrosine inhibitor compounds or compounds that affect protein tyrosine kinase signaling pathways, e.g., Src tyrosine kinase, or that are resistant in different biological systems to those compounds. The method comprises the step(s) of (i) analyzing the expression of only those polynucleotides listed in Tables 2, 4, 5, or any combination thereof, that have been shown to be correlative to predicting resistant responses to such compounds; (ii) comparing the observed expression levels of those correlative resistant polynucleotides in the test cells, tissues, and/or patients to the expression levels of those same polynucleotides in a cell line that is known to be resistant to the compounds; and (iii) predicting whether the cells, tissues, and/or patients are resistant to the compounds based upon the overall similarity of the observed expression of those polynucleotides in step (ii).

In another embodiment, the present invention is directed to a method of identifying cells, tissues, and/or patients that are predicted to be sensitive to either protein tyrosine inhibitor compounds or compounds that affect protein tyrosine kinase signaling pathways, e.g., the Src tyrosine kinase, or that are sensitive in different biological systems to those compounds. The method involves the step(s) of (i) analyzing the expression of only those polynucleotides listed in Tables 2, 4, 5, or any combination thereof, that have been shown to be correlative to predicting sensitive responses to such compounds; (ii) comparing the observed expression levels of those correlative sensitive polynucleotides in the test cells, tissues, and/or patients to the expression levels of those same polynucleotides in a cell line that is known to be sensitive to the compounds; and (iii) predicting whether the cells, tissues, and/or patients are sensitive to the compounds based upon the overall similarity of the observed expression of those polynucleotides in step (ii).

The present invention further encompasses the detection and/or quantification of one or more of the protein tyrosine kinase biomarker proteins of the present invention using antibody-based assays (e.g., immunoassays) and/or detection systems. As mentioned, protein tyrosine kinases encompass members of the Src family of tyrosine kinases, for example, Src, Fgr, Fyn, Yes, Blk, Hck, Lck and Lyn, as well as other protein tyrosine kinases, including, Bcr-abl, Jak, PDGFR, c-kit and Eph receptors. Such assays include the following non-limiting examples, ELISA, immunofluorescence, fluorescence activated cell sorting (FACS), Western Blots, etc., as further described herein.

In another embodiment, the human protein tyrosine kinase biomarker polypeptides and/or peptides of the present invention, or immunogenic fragments or oligopeptides thereof, can be used for screening therapeutic drugs or compounds in a variety of drug screening techniques. The fragment employed in such a screening assay can be free in solution, affixed to a solid support, borne on a cell surface, or located intracellularly. The reduction or abolition of activity of the formation of binding complexes between the biomarker protein and the agent being tested can be measured. Thus, the present invention provides a method for screening or assessing a plurality of compounds for their specific binding affinity with a protein kinase inhibitor biomarker polypeptide, or a bindable peptide fragment thereof, of this invention. The method comprises the steps of providing a plurality of compounds; combining the protein kinase inhibitor biomarker polypeptide, or a bindable peptide fragment thereof, with each of the plurality of compounds, for a time sufficient to allow binding under suitable conditions; and detecting binding of the biomarker polypeptide or peptide to each of the plurality of test compounds, thereby identifying the compounds that specifically bind to the biomarker polypeptide or peptide. More specifically, the biomarker polypeptide or peptide is that of a Src tyrosine kinase inhibitor biomarkers.

Methods to identify compounds that modulate the activity of the human protein tyrosine kinase biomarker polypeptides and/or peptides provided in Table 2 by the present invention, comprise combining a candidate compound or drug modulator of protein kinases and measuring an effect of the candidate compound or drug modulator on the biological activity of the protein kinase inhibitor biomarker polypeptide or peptide. Such measurable effects include, for example, a physical binding interaction; the ability to cleave a suitable protein kinase substrate; effects on a native and cloned protein kinase biomarker-expressing cell line; and effects of modulators or other protein kinase-mediated physiological measures.

Another method of identifying compounds that modulate the biological activity of the protein tyrosine kinase biomarker polypeptides of the present invention comprises combining a potential or candidate compound or drug modulator of a protein tyrosine kinase biological activity, e.g., a Src tyrosine kinase, with a host cell that expresses the protein tyrosine kinase biomarker polypeptide and measuring an effect of the candidate compound or drug modulator on the biological activity of the protein tyrosine kinase biomarker polypeptides. The host cell can also be capable of being induced to express the protein tyrosine kinase biomarker polypeptide, e.g., via inducible expression. Physiological effects of a given modulator candidate on the protein tyrosine kinase biomarker polypeptide can also be measured. Thus, cellular assays for particular protein tyrosine kinase modulators, e.g., a src kinase modulator, can be either direct measurement or quantification of the physical biological activity of the protein tyrosine kinase biomarker polypeptide, or they may be measurement or quantification of a physiological effect. Such methods preferably employ a protein tyrosine kinase biomarker polypeptide as described herein, or an overexpressed recombinant protein tyrosine kinase biomarker polypeptide in suitable host cells containing an expression vector as described herein, wherein the protein tyrosine kinase biomarker polypeptide is expressed, overexpressed, or undergoes up-regulated expression.

Another aspect of the present invention embraces a method of screening for a compound that is capable of modulating the biological activity of a protein tyrosine kinase biomarker polypeptide, e.g., a Src kinase biomarker polypeptide. The method comprises providing a host cell containing an expression vector harboring a nucleic acid sequence encoding a protein tyrosine kinase biomarker polypeptide, or a functional peptide or portion thereof (e.g., the src polypeptide, protein, peptide, or fragment sequences as set forth in Table 2, or the Sequence Listing herein); determining the biological activity of the expressed protein tyrosine kinase biomarker polypeptide in the absence of a modulator compound; contacting the cell with the modulator compound and determining the biological activity of the expressed protein tyrosine kinase biomarker polypeptide in the presence of the modulator compound. In such a method, a difference between the activity of the protein tyrosine kinase biomarker polypeptide in the presence of the modulator compound and in the absence of the modulator compound indicates a modulating effect of the compound.

Essentially any chemical compound can be employed as a potential modulator or ligand in the assays according to the present invention. Compounds tested as protein tyrosine kinase modulators can be any small chemical compound, or biological entity (e.g., protein, sugar, nucleic acid, or lipid). Test compounds are typically small chemical molecules and peptides. Generally, the compounds used as potential modulators can be dissolved in aqueous or organic (e.g., DMSO-based) solutions. The assays are designed to screen large chemical libraries by automating the assay steps and providing compounds from any convenient source. Assays are typically run in parallel, for example, in microtiter formats on microtiter plates in robotic assays. There are many suppliers of chemical compounds, including, for example, Sigma (St. Louis, Mo.), Aldrich (St. Louis, Mo.), Sigma-Aldrich (St. Louis, Mo.), Fluka Chemika-Biochemica Analytika (Buchs, Switzerland). Also, compounds can be synthesized by methods known in the art.

High throughput screening methodologies are particularly envisioned for the detection of modulators of the novel protein tyrosine kinase biomarker, e.g., src biomarker, polynucleotides and polypeptides described herein. Such high throughput screening methods typically involve providing a combinatorial chemical or peptide library containing a large number of potential therapeutic compounds (e.g., ligand or modulator compounds). The combinatorial chemical libraries or ligand libraries are then screened in one or more assays to identify those library members (e.g., particular chemical species or subclasses) that display a desired characteristic activity. The compounds so identified can serve as conventional lead compounds, or can themselves be used as potential or actual therapeutics.

A combinatorial chemical library is a collection of diverse chemical compounds generated either by chemical synthesis or biological synthesis, prepared by combining a number of chemical building blocks (i.e., reagents such as amino acids). As an example, a linear combinatorial library, e.g., a polypeptide or peptide library, is formed by combining a set of chemical building blocks in every possible way for a given compound length (i.e., the number of amino acids in a polypeptide or peptide compound). Millions of chemical compounds can be synthesized through such combinatorial mixing of chemical building blocks.

The preparation and screening of combinatorial chemical libraries is well known to those having skill in the pertinent art. Combinatorial libraries include, without limitation, peptide libraries (e.g. U.S. Pat. No. 5,010,175; Furka, 1991, *Int. J. Pept. Prot. Res.*, 37:487-493; and Houghton et al., 1991, *Nature*, 354:84-88). Other chemistries for generating chemical diversity libraries can also be used. Nonlimiting examples of chemical diversity library chemistries include, peptoids (PCT Publication No. WO 91/019735), encoded peptides (PCT Publication No. WO 93/20242), random bio-oligomers (PCT Publication No. WO 92/00091), benzodiazepines (U.S. Pat. No. 5,288,514), diversomers such as hydantoins, benzodiazepines and dipeptides (Hobbs et al., 1993, *Proc. Natl. Acad. Sci. USA,* 90:6909-6913), vinylogous polypeptides (Hagihara et al., 1992, *J. Amer. Chem. Soc.*, 114:6568), non-peptidal peptidomimetics with glucose scaffolding (Hirschmann et al., 1992, *J. Amer. Chem. Soc.*, 114:9217-9218), analogous organic synthesis of small compound libraries (Chen et al., 1994, *J. Amer. Chem. Soc.*, 116:2661), oligocarbamates (Cho et al., 1993, *Science*, 261:1303), and/or peptidyl phosphonates (Campbell et al., 1994, *J. Org. Chem.*, 59:658), nucleic acid libraries (see Ausubel, Berger and Sambrook, all supra), peptide nucleic acid libraries (U.S. Pat. No. 5,539,083), antibody libraries (e.g., Vaughn et al., 1996, *Nature Biotechnology*, 14(3):309-314) and PCT/US96/10287), carbohydrate libraries (e.g., Liang et al., 1996, *Science*, 274-1520-1522) and U.S. Pat. No. 5,593,853), small organic molecule libraries (e.g., benzodiazepines, Baum C&EN, Jan. 18, 1993, page 33; and U.S. Pat. No. 5,288,514; isoprenoids (U.S. Pat. No. 5,569,588); thiazolidinones and metathiazanones (U.S. Pat. No. 5,549,974); pyrrolidines (U.S. Pat. Nos. 5,525,735 and 5,519,134); morpholino compounds (U.S. Pat. No. 5,506,337); and the like.

Devices for the preparation of combinatorial libraries are commercially available (e.g., 357 MPS, 390 MPS, Advanced Chem Tech, Louisville Ky.; Symphony, Rainin, Woburn, Mass.; 433A Applied Biosystems, Foster City, Calif.; 9050 Plus, Millipore, Bedford, Mass.). In addition, a large number of combinatorial libraries are commercially available (e.g., ComGenex, Princeton, N.J.; Asinex, Moscow, Russia; Tripos, Inc., St. Louis, Mo.; ChemStar, Ltd., Moscow, Russia; 3D Pharmaceuticals, Exton, Pa.; Martek Biosciences, Columbia, Md., and the like).

In one aspect, the invention provides solid phase-based in vitro assays in a high throughput format, where the cell or tissue expressing a tyrosine kinase protein/polypeptide/peptide is attached to a solid phase substrate. In such high throughput assays, it is possible to screen up to several thousand different modulators or ligands in a single day. In particular, each well of a microtiter plate can be used to perform a separate assay against a selected potential modulator, or, if concentration or incubation time effects are to be observed, every 5-10 wells can be used to test a single modulator. Thus, a single standard microtiter plate can be used in to assay about 96 modulators. If 1536 well plates are used, then a single plate can easily assay from about 100 to about 1500 different compounds. It is possible to assay several different plates per day; thus, for example, assay screens for up to about 6,000-20,000 different compounds are possible using the described integrated systems.

In another of its aspects, the present invention encompasses screening and small molecule (e.g., drug) detection assays which involve the detection or identification of small molecules that can bind to a given protein, i.e., a tyrosine kinase biomarker polypeptide or peptide, such as a Src tyrosine kinase biomarker polypeptide or peptide. Particularly preferred are assays suitable for high throughput screening methodologies.

In such binding-based detection, identification, or screening assays, a functional assay is not typically required. All that is needed, in general, is a target protein, preferably substantially purified, and a library or panel of compounds (e.g., ligands, drugs, or small molecules), or biological entities to be screened or assayed for binding to the protein target. Preferably, most small molecules that bind to the target protein modulate the target's activity in some manner due to preferential, higher affinity binding to functional areas or sites on the protein.

An example of such an assay is the fluorescence based thermal shift assay (3-Dimensional Pharmaceuticals, Inc., 3DP, Exton, Pa.) as described in U.S. Pat. Nos. 6,020,141 and 6,036,920 to Pantoliano et al. (See also, J. Zimmerman, 2000, *Gen. Eng. News*, 20(8)). The assay allows the detection of small molecules (e.g., drugs, ligands) that bind to expressed, and preferably purified, tyrosine kinase biomarker proteins/polypeptides/peptides, such as the Src tyrosine kinase, based on affinity of binding determinations by analyzing thermal unfolding curves of protein-drug or ligand complexes. The drugs or binding molecules determined by this technique can be further assayed, if desired, by methods such as those described herein to determine if the molecules affect or modulate function or activity of the target protein.

To purify a tyrosine kinase biomarker polypeptide or peptide, e.g., Src tyrosine kinase, to measure a biological binding or ligand binding activity, the source may be a whole cell lysate that can be prepared by successive freeze-thaw cycles (e.g., one to three) in the presence of standard protease inhibitors. The tyrosine kinase biomarker polypeptide can be partially or completely purified by standard protein purification methods, e.g., affinity chromatography using specific antibody(ies) described herein, or by ligands specific for an epitope tag engineered into the recombinant tyrosine kinase biomarker polypeptide molecule, also as described herein. Binding activity can then be measured as described.

Compounds which are identified according to the methods provided herein, and which modulate or regulate the biological activity or physiology of the tyrosine kinase biomarker polypeptides according to the present invention, are a preferred embodiment of this invention. It is contemplated that such modulatory compounds can be employed in treatment and therapeutic methods for treating a condition that is mediated by the tyrosine kinase biomarker polypeptides, e.g., Src tyrosine kinase biomarker polypeptides, by administering to an individual in need of such treatment a therapeutically effective amount of the compound identified by the methods described herein.

In addition, the present invention provides methods for treating an individual in need of such treatment for a disease, disorder, or condition that is mediated by the tyrosine kinase biomarker polypeptides of the invention, comprising administering to the individual a therapeutically effective amount of the tyrosine kinase biomarker-modulating compound identified by a method provided herein. In accordance with this invention, the tyrosine kinase biomarker polypeptides or proteins encompassed by the methods include members of the Src family of tyrosine kinases, for example, Src, Fgr, Fyn, Yes, Blk, Hck, Lck and Lyn, as well as other protein tyrosine kinases, including, Bcr-abl, Jak, PDGFR, c-kit and Eph receptors.

The present invention particularly provides methods for treating an individual in need of such treatment for a disease, disorder, or condition that is mediated by Src biomarker polypeptides of the invention, comprising administering to the individual a therapeutically effective amount of the Src biomarker-modulating compound identified by a method provided herein.

The present invention further encompasses polypeptides comprising, or alternatively consisting of, an epitope of the polypeptide having an amino acid sequence of one or more of the protein tyrosine kinase biomarkers, preferably the Src biomarker amino acid sequences as set forth in Table 2. The present invention also encompasses polynucleotide sequences encoding an epitope of a polypeptide sequence of the protein tyrosine kinase biomarkers of the invention.

The term "epitopes" as used herein, refers to portions of a polypeptide having antigenic or immunogenic activity in an animal, preferably a mammal, and most preferably a human. In a preferred embodiment, the present invention encompasses a polypeptide comprising an epitope, as well as the polynucleotide encoding this polypeptide. An "immunogenic epitope" as used herein, refers to a portion of a protein that elicits an antibody response in an animal, as determined by any method known in the art, for example, by the methods for generating antibodies described infra. (See, for example, Geysen et al., 1983, *Proc. Natl. Acad. Sci. USA*, 81:3998-4002). The term "antigenic epitope" as used herein refers to a portion of a protein to which an antibody can immunospecifically bind to its antigen as determined by any method well known in the art, for example, by the immunoassays described herein. Immunospecific binding excludes non-specific binding, but does not necessarily exclude cross-reactivity with other antigens. Antigenic epitopes need not necessarily be immunogenic. Either the full-length protein or an antigenic peptide fragment can be used. Antibodies are preferably prepared from these regions or from discrete fragments in regions of the tyrosine kinase biomarker nucleic acid and protein sequences comprising an epitope. Polypeptide or peptide fragments that function as epitopes may be produced by any conventional means. (See, e.g., Houghten, 1985, *Proc. Natl. Acad. Sci. USA*, 82:5131-5135; and as described in U.S. Pat. No. 4,631,211).

Moreover, antibodies can also be prepared from any region of the polypeptides and peptides of the protein tyrosine kinase biomarkers, including Src kinase biomarkers as described herein. In addition, if a polypeptide is a receptor protein, antibodies can be developed against an entire receptor or portions of the receptor, for example, the intracellular carboxy terminal domain, the amino terminal extracellular domain, the entire transmembrane domain, specific transmembrane segments, any of the intracellular or extracellular loops, or any portions of these regions. Antibodies can also be developed against specific functional sites, such as the site of ligand binding, or sites that are glycosylated, phosphorylated, myristylated, or amidated, for example.

In the present invention, antigenic epitopes for generating antibodies preferably contain a sequence of at least 4, at least 5, at least 6, at least 7, more preferably at least 8, at least 9, at least 10, at least 11, at least 12, at least 13, at least 14, at least 15, at least 20, at least 25, at least 30, at least 40, at least 50, and, most preferably, between about 15 to about 30 amino acid residues. Combinations of the foregoing epitopes are included. Preferred polypeptides comprising immunogenic or antigenic epitopes are at least 10, 15, 20, 25, 30, 35, 40, 45, 50, 55, 60, 65, 70, 75, 80, 85, 90, 95, or 100 amino acid residues in length. Additional non-exclusive preferred antigenic epitopes include the antigenic epitopes disclosed herein, as well as portions thereof, as well as any combination of two, three, four, five or more of these antigenic epitopes. Such antigenic epitopes can be used as the target molecules in immunoassays. (See, for instance, Wilson et al., 1984, *Cell*, 37:767-778; and Sutcliffe et al., 1983, *Science*, 219:660-666). The fragments as described herein are not to be construed, however, as encompassing any fragments which may be disclosed prior to the invention.

Protein tyrosine kinase biomarker polypeptides comprising one or more immunogenic epitopes which elicit an antibody response can be introduced together with a carrier protein, such as an albumin, to an animal system (such as rabbit or mouse). Alternatively, if the polypeptide is of sufficient length (e.g., at least about 15-25 amino acids), the polypeptide can be presented without a carrier. However, immunogenic epitopes comprising as few as 5 to 10 amino acids have been shown to be sufficient to raise antibodies capable of binding to, at the very least, linear epitopes in a denatured polypeptide (e.g., in Western blotting).

Epitope-bearing polypeptides of the present invention can be used to induce antibodies according to methods well known in the art including, but not limited to, in vivo immunization, in vitro immunization, and phage display methods. See, e.g., Sutcliffe et al., supra; Wilson et al., supra; and Bittle et al., supra). If in vivo immunization is used, animals can be immunized with free peptide of appropriate size; however, the anti-peptide antibody titer can be boosted by coupling the peptide to a macromolecular carrier, such as keyhole limpet hemacyanin (KLH), or tetanus toxoid (TT). For instance, peptides containing cysteine residues can be coupled to a carrier using a linker such as maleimidobenzoyl-N-hydroxysuccinimide ester (MBS), while other peptides may be coupled to carriers using a more general linking agent, such as glutaraldehyde.

Peptides containing epitopes can also be synthesized as multiple antigen peptides (MAPs), first described by J. P. Tam et al. (1995, *Biomed. Pept., Proteins, Nucleic Acids*, 199, 1(3):123-32) and Calvo et al. (1993, *J. Immunol.*, 150(4): 1403-12), which are hereby incorporated by reference in their entirety herein. MAPs contain multiple copies of a specific peptide attached to a non-immunogenic lysine core. MAP peptides usually contain four or eight copies of the peptide, which are often referred to as MAP4 or MAP8 peptides. By way of non-limiting example, MAPs can be synthesized onto a lysine core matrix attached to a polyethylene glycol-polystyrene (PEG-PS) support. The peptide of interest is synthesized onto the lysine residues using 9-fluorenylmethoxycarbonyl (Fmoc) chemistry. For example, Applied Biosystems (Foster City, Calif.) offers commercially available MAP resins, such as, for example, the Fmoc Resin 4 Branch and the Fmoc Resin 8 Branch which can be used to synthesize MAPs. Cleavage of MAPs from the resin is performed with standard trifloroacetic acid (TFA)-based cocktails known in the art. Purification of MAPs, except for desalting, is not generally necessary. MAP peptides can be used in immunizing vaccines which elicit antibodies that recognize both the MAP and the native protein from which the peptide was derived.

Epitope-bearing peptides of the invention can also be incorporated into a coat protein of a virus, which can then be used as an immunogen or a vaccine with which to immunize animals, including humans, in order stimulate the production of anti-epitope antibodies. For example, the V3 loop of the gp120 glycoprotein of the human immunodeficiency virus type 1 (HIV-1) has been engineered to be expressed on the surface of rhinovirus. Immunization with rhinovirus displaying the V3 loop peptide yielded apparently effective mimics of the HIV-1 immunogens (as measured by their ability to be neutralized by anti-HIV-1 antibodies as well as by their ability to elicit the production of antibodies capable of neutralizing HIV-1 in cell culture). This techniques of using engineered viral particles as immunogens is described in more detail in Smith et al., 1997, *Behring Inst Mitt Feb*, (98):229-39; Smith et al., 1998, *J. Virol.*, 72:651-659; and Zhang et al., 1999, *Biol. Chem.*, 380:365-74), which are hereby incorporated by reference herein in their entireties.

Moreover, polypeptides or peptides containing epitopes according to the present invention can be modified, for example, by the addition of amino acids at the amino- and/or carboxy-terminus of the peptide. Such modifications are performed, for example, to alter the conformation of the epitope bearing polypeptide such that the epitope will have a conformation more closely related to the structure of the epitope in the native protein. An example of a modified epitope-bearing polypeptide of the invention is a polypeptide in which one or more cysteine residues have been added to the polypeptide to allow for the formation of a disulfide bond between two cysteines, thus resulting in a stable loop structure of the epitope-bearing polypeptide under non-reducing conditions. Disulfide bonds can form between a cysteine residue added to the polypeptide and a cysteine residue of the naturally-occurring epitope, or between two cysteines which have both been added to the naturally-occurring epitope-bearing polypeptide.

In addition, it is possible to modify one or more amino acid residues of the naturally-occurring epitope-bearing polypeptide by substitution with cysteines to promote the formation of disulfide bonded loop structures. Cyclic thioether molecules of synthetic peptides can be routinely generated using techniques known in the art, e.g., as described in PCT publication WO 97/46251, incorporated in its entirety by reference herein. Other modifications of epitope-bearing polypeptides contemplated by this invention include biotinylation.

For the production of antibodies in vivo, host animals, such as rabbits, rats, mice, sheep, or goats, are immunized with either free or carrier-coupled peptides or MAP peptides, for example, by intraperitoneal and/or intradermal injection. Injection material is typically an emulsion containing about 100 µg of peptide or carrier protein and Freund's adjuvant, or any other adjuvant known for stimulating an immune response. Several booster injections may be needed, for instance, at intervals of about two weeks, to provide a useful titer of anti-peptide antibody which can be detected, for example, by ELISA assay using free peptide adsorbed to a solid surface. The titer of anti-peptide antibodies in serum from an immunized animal can be increased by selection of anti-peptide antibodies, e.g., by adsorption of the peptide onto a solid support and elution of the selected antibodies according to methods well known in the art.

As one having skill in the art will appreciate, and as discussed above, the tyrosine kinase biomarker polypeptides of the present invention, which include the following: e.g., members of the Src family of tyrosine kinases, such as Src, Fgr, Fyn, Yes, Blk, Hck, Lck and Lyn, as well as other protein tyrosine kinases, including, Bcr-abl, Jak, PDGFR, c-kit and Eph receptors, and which comprise an immunogenic or antigenic epitope, can be fused to other polypeptide sequences. For example, the polypeptides of the present invention can be fused with the constant domain of immunoglobulins (IgA, IgE, IgG, IgD, or IgM), or portions thereof, e.g., CH1, CH2, CH3, or any combination thereof, and portions thereof, or with albumin (including, but not limited to, recombinant human albumin, or fragments or variants thereof (see, e.g., U.S. Pat. No. 5,876,969; EP Patent No. 0 413 622; and U.S. Pat. No. 5,766,883, incorporated by reference in their entirety herein), thereby resulting in chimeric polypeptides. Such fusion proteins may facilitate purification and may increase half-life in vivo. This has been shown for chimeric proteins containing the first two domains of the human CD4-polypeptide and various domains of the constant regions of the heavy or light chains of mammalian immunoglobulins. (see, e.g., Traunecker et al., 1988, *Nature*, 331:84-86).

Enhanced delivery of an antigen across the epithelial barrier to the immune system has been demonstrated for antigens (e.g., insulin) conjugated to an FcRn binding partner, such as IgG or Fc fragments (see, e.g., WO 96/22024 and WO 99/04813). IgG fusion proteins that have a disulfide-linked dimeric structure due to the IgG portion disulfide bonds have also been found to be more efficient in binding and neutralizing other molecules than are monomeric polypeptides, or fragments thereof, alone. (See, e.g., Fountoulakis et al., 1995, *J. Biochem.*, 270:3958-3964).

Nucleic acids encoding epitopes can also be recombined with a polynucleotide of interest as an epitope tag (e.g., the hemagglutinin ("HA") tag or flag tag) to aid in detection and purification of the expressed polypeptide. For example, a system for the ready purification of non-denatured fusion proteins expressed in human cell lines has been described by Janknecht et al., (1991, *Proc. Natl. Acad. Sci. USA*, 88:8972-897). In this system, the polynucleotide of interest is subcloned into a vaccinia recombination plasmid such that the open reading frame of the polynucleotide is translationally fused to an amino-terminal tag having six histidine residues. The tag serves as a matrix binding domain for the fusion protein. Extracts from cells infected with the recombinant vaccinia virus are loaded onto an $Ni^{2+}$ nitriloacetic acid-agarose column and histidine-tagged proteins are selectively eluted with imidazole-containing buffers.

Additional fusion proteins of the invention can be generated by employing the techniques of gene-shuffling, motif-shuffling, exon-shuffling, and/or codon-shuffling (collectively referred to as "DNA shuffling"). DNA shuffling can be employed to modulate the activities of polypeptides of the invention; such methods can be used to generate polypeptides with altered activity, as well as agonists and antagonists of the polypeptides. See, generally, U.S. Pat. Nos. 5,605,793; 5,811,238; 5,830,721; 5,834,252; and 5,837,458, and Patten et al., 1997, *Curr. Opinion Biotechnol.*, 8:724-33; Harayama, 1998, *Trends Biotechnol.*, 16(2):76-82; Hansson, et al., 1999, *J. Mol. Biol.*, 287:265-76; and Lorenzo and Blasco, 1998, *Biotechniques*, 24(2):308-313, the contents of each of which are hereby incorporated by reference in its entirety.

In an embodiment of the invention, alteration of polynucleotides corresponding to one or more of the src biomarker polynucleotide sequences as set forth in Table 2, and the polypeptides encoded by these polynucleotides, can be achieved by DNA shuffling. DNA shuffling involves the assembly of two or more DNA segments by homologous or site-specific recombination to generate variation in the polynucleotide sequence. In another embodiment, polynucleotides of the invention, or their encoded polypeptides, may be altered by being subjected to random mutapolynucleotidesis by error-prone PCR, random nucleotide insertion, or other methods, prior to recombination. In another embodiment, one or more components, motifs, sections, parts, domains, fragments, etc., of a polynucleotide encoding a polypeptide of this invention may be recombined with one or more components, motifs, sections, parts, domains, fragments, etc. of one or more heterologous molecules.

Another aspect of the present invention relates to antibodies and T-cell antigen receptors (TCRs), which immunospecifically bind to a polypeptide, polypeptide fragment, or variant one or more of the src biomarker amino acid sequences as set forth in Table 2, and/or an epitope thereof, of the present invention (as determined by immunoassays well known in the art for assaying specific antibody-antigen binding).

A bispecific or bifunctional antibody is an artificial hybrid antibody having two different heavy/light chain pairs and two different binding sites. Bispecific antibodies can be produced by a variety of methods, including fusion of hybridomas or linking of Fab' fragments. (See, e.g., Songsivilai & Lachmann, 1990, Clin. Exp. Immunol., 79:315-321; Kostelny et al., 1992, J. Immunol., 148:1547 1553). In addition, bispecific antibodies can be formed as "diabodies" (See, Holliger et al., 1993, Proc. Natl. Acad. Sci. USA, 90:6444-6448), or "Janusins" (See, Traunecker et al., 1991, EMBO J., 10:3655-3659 and Traunecker et al., 1992, Int. J. Cancer Suppl. 7:51-52-127).

Antibodies of the invention include, but are not limited to, polyclonal, monoclonal, multispecific, human, humanized or chimeric antibodies, single chain antibodies, Fab fragments, F(ab') fragments, fragments produced by a Fab expression library, anti-idiotypic (anti-Id) antibodies (including, e.g., anti-Id antibodies to antibodies of the invention), intracellularly made antibodies (i.e., intrabodies), and epitope-binding fragments of any of the above. The term "antibody", as used herein, refers to immunoglobulin molecules and immunologically active portions or fragments of immunoglobulin molecules, i.e., molecules that contain an antigen binding site that immunospecifically binds an antigen. The immunoglobulin molecules of the invention can be of any type (e.g., IgG, IgE, IgM, IgD, IgA and IgY), class or subclass (e.g., IgG1, IgG2, IgG3, IgG4, IgA1 and IgA2) of immunoglobulin molecule. Preferably, immunoglobulin is an IgG1, an IgG2, or an IgG4 isotype.

Immunoglobulins may have both a heavy and a light chain. An array of IgG, IgE, IgM, IgD, IgA, and IgY heavy chains can be paired with a light chain of the kappa or lambda types. Most preferably, the antibodies of the present invention are human antigen-binding antibodies and antibody fragments and include, but are not limited to, Fab, Fab' F(ab') 2, Fd, single-chain Fvs (scFv), single-chain antibodies, disulfide-linked Fvs (sdFv) and fragments comprising either a $V_L$ or $V_H$ domain. Antigen-binding antibody fragments, including single-chain antibodies, can comprise the variable region(s) alone or in combination with the entirety or a portion of the following: hinge region, and CH1, CH2, and CH3 domains. Also included in connection with the invention are antigen-binding fragments comprising any combination of variable region(s) with a hinge region, and CH1, CH2, and CH3 domains. The antibodies of the invention can be from any animal origin including birds and mammals. Preferably, the antibodies are of human, murine (e.g., mouse and rat), donkey, sheep, rabbit, goat, guinea pig, camel, horse, or chicken origin. As used herein, "human" antibodies include antibodies having the amino acid sequence of a human immunoglobulin and include antibodies isolated from human immunoglobulin libraries or from animals transgenic for one or more human immunoglobulin and that do not express endogenous immunoglobulins, as described infra and, for example, in U.S. Pat. No. 5,939,598.

The antibodies of the present invention can be monospecific, bispecific, trispecific, or of greater multispecificity. Multispecific antibodies can be specific for different epitopes of a polypeptide of the present invention, or can be specific for both a polypeptide of the present invention, and a heterologous epitope, such as a heterologous polypeptide or solid support material. (See, e.g., WO 93/17715; WO 92/08802; WO 91/00360; WO 92/05793; Tutt et al., 1991, J. Immunol., 147:60-69; U.S. Pat. Nos. 4,474,893; 4,714,681; 4,925,648; 5,573,920; 5,601,819; and Kostelny et al., 1992, J. Immunol., 148:1547-1553).

Antibodies of the present invention can be described or specified in terms of the epitope(s) or portion(s) of a polypeptide of the present invention which they recognize or specifically bind. The epitope(s) or polypeptide portion(s) can be specified, e.g., by N-terminal and C-terminal positions, by size in contiguous amino acid residues, or as presented in the sequences defined in Table 2 herein. Further included in accordance with the present invention are antibodies which bind to polypeptides encoded by polynucleotides which hybridize to a polynucleotide of the present invention under stringent, or moderately stringent, hybridization conditions as described herein.

The antibodies of the invention (including molecules comprising, or alternatively consisting of, antibody fragments or variants thereof) can bind immunospecifically to a polypeptide or polypeptide fragment or to a variant human protein tyrosine kinase biomarker of the invention, e.g., the Src biomarker proteins as set forth in Table 2, and/or monkey src biomarker protein.

By way of non-limiting example, an antibody can be considered to bind to a first antigen preferentially if it binds to the first antigen with a dissociation constant (Kd) that is less than the antibody's Kd for the second antigen. In another non-limiting embodiment, an antibody can be considered to bind to a first antigen preferentially if it binds to the first antigen with an affinity that is at least one order of magnitude less than the antibody's Ka for the second antigen. In another non-limiting embodiment, an antibody can be considered to bind to a first antigen preferentially if it binds to the first antigen with an affinity that is at least two orders of magnitude less than the antibody's Kd for the second antigen.

In another nonlimiting embodiment, an antibody may be considered to bind to a first antigen preferentially if it binds to the first antigen with an off rate (koff) that is less than the antibody's koff for the second antigen. In another nonlimiting embodiment, an antibody can be considered to bind to a first antigen preferentially if it binds to the first antigen with an affinity that is at least one order of magnitude less than the antibody's koff for the second antigen. In another nonlimiting embodiment, an antibody can be considered to bind to a first antigen preferentially if it binds to the first antigen with an affinity that is at least two orders of magnitude less than the antibody's koff for the second antigen.

Antibodies of the present invention can also be described or specified in terms of their binding affinity to a tyrosine kinase biomarker polypeptide of the present invention, e.g., members of the Src family of tyrosine kinases, for example, Src, Fgr, Fyn, Yes, Blk, Hck, Lck and Lyn, as well as other protein tyrosine kinases, including, Bcr-abl, Jak, PDGFR, c-kit and Eph receptors. Preferred binding affinities include those with a dissociation constant or Kd of less than $5 \times 10^{-2}$ M, $1 \times 10^{-2}$ M, $5 \times 10^{-3}$ M, $1 \times 10^{-3}$ M, $5 \times 10^{-4}$ M, or $1 \times 10^{-4}$ M.

More preferred binding affinities include those with a dissociation constant or Kd less than $5\times10^{-5}$ M, $1\times10^{-5}$ M, $5\times10^{-6}$ M, $1\times10^{-6}$ M, $5\times10^{-7}$ M, $1\times10^{-7}$ M, $5\times10^{-8}$ M, or $1\times10^{-8}$ M. Even more preferred antibody binding affinities include those with a dissociation constant or Kd of less than $5\times10^{-9}$ M, $1\times10^{-9}$ M, $5\times10^{-10}$ M, $1\times10^{-10}$ M, $5\times10^{-11}$ M, $1\times10^{-11}$ M, $5\times10^{-12}$ M, $1\times10^{-12}$ M, $5\times10^{-13}$ M, $1\times10^{-13}$ M, $5\times10^{-14}$ M, $1\times10^{-14}$ M, $5\times10^{-15}$ M, or $1\times10^{-15}$ M.

In specific embodiments, antibodies of the invention bind to the protein tyrosine kinase biomarker polypeptides, or fragments, or variants thereof, with an off rate (koff) of less than or equal to about $5\times10^{-2}$ sec$^{-1}$, $1\times10^{-2}$ sec$^{-1}$, $5\times10^{-3}$ sec$^{-1}$, or $1\times10^{-3}$ sec$^{-1}$. More preferably, antibodies of the invention bind to src biomarker protein polypeptides or fragments or variants thereof with an off rate (koff) of less than or equal to about $5\times10^{-4}$ sec$^{-1}$, $1\times10^{-4}$ sec$^{-1}$, $5\times10^{-5}$ sec$^{-1}$, $1\times10^{-5}$ sec$^{-1}$, $5\times10^{-6}$ sec$^{-1}$, $1\times10^{-6}$ sec$^{-1}$, $5\times10^{-7}$ sec$^{-1}$, or $1\times10^{-7}$ sec$^{-1}$.

In other embodiments, antibodies of the invention bind to protein tyrosine kinase biomarker polypeptides or fragments or variants thereof with an on rate (kon) of greater than or equal to $1\times10^{3}$ M$^{-1}$ sec$^{-1}$, $5\times10^{3}$ M$^{-1}$ sec$^{-1}$, $1\times10^{4}$ M$^{-1}$ sec$^{-1}$, or $5\times10^{4}$ M$^{-1}$ sec$^{-1}$. More preferably, antibodies of the invention bind to protein tyrosine kinase biomarker polypeptides or fragments or variants thereof with an on rate greater than or equal to $1\times10^{5}$ M$^{-1}$ sec$^{-1}$, $5\times10^{5}$ M$^{-1}$ sec$^{-1}$, $1\times10^{6}$ M$^{-1}$ sec$^{-1}$, $5\times10^{6}$ M$^{-1}$ sec$^{-1}$, or $1\times10^{-7}$ M$^{-1}$ sec$^{-1}$.

The present invention also provides antibodies that competitively inhibit the binding of an antibody to an epitope of the invention as determined by any method known in the art for determining competitive binding, for example, the immunoassays as described herein. In preferred embodiments, the antibody competitively inhibits binding to an epitope by at least 95%, at least 90%, at least 85%, at least 80%, at least 75%, at least 70%, at least 60%, or at least 50%.

Antibodies of the present invention can act as agonists or antagonists of the protein tyrosine kinase biomarker polypeptides of the present invention. For example, the present invention includes antibodies which disrupt receptor/ligand interactions with polypeptides of the invention either partially or fully. The invention includes both receptor-specific antibodies and ligand-specific antibodies. The invention also includes receptor-specific antibodies which do not prevent ligand binding, but do prevent receptor activation. Receptor activation (i.e., signaling) can be determined by techniques described herein or as otherwise known in the art. For example, receptor activation can be determined by detecting the phosphorylation (e.g., on tyrosine or serine/threonine) of the receptor or its substrate by immunoprecipitation followed by Western Blot analysis. In specific embodiments, antibodies are provided that inhibit ligand activity or receptor activity by at least 95%, at least 90%, at least 85%, at least 80%, at least 75%, at least 70%, at least 60%, or at least 50% of the activity in the absence of the antibody.

In another embodiment of the present invention, antibodies that immunospecifically bind to a protein tyrosine kinase biomarker, or a fragment or variant thereof, comprise a polypeptide having the amino acid sequence of any one of the heavy chains expressed by an anti-protein tyrosine kinase biomarker antibody-expressing cell line of the invention, and/or any one of the light chains expressed by an anti-protein tyrosine kinase biomarker antibody-expressing cell line of the invention.

In another embodiment of the present invention, antibodies that immunospecifically bind to a tyrosine kinase biomarker protein or a fragment or variant thereof, comprise a polypeptide having the amino acid sequence of any one of the $V_H$ domains of a heavy chain expressed by an anti-protein tyrosine kinase biomarker antibody-expressing cell line, and/or any one of the $V_L$ domains of a light chain expressed by an anti-protein tyrosine kinase biomarker antibody-expressing cell line. In preferred embodiments, antibodies of the present invention comprise the amino acid sequence of a $V_H$ domain and $V_L$ domain expressed by a single anti-protein tyrosine kinase biomarker protein antibody-expressing cell line. In alternative embodiments, antibodies of the present invention comprise the amino acid sequence of a $V_H$ domain and a $V_L$ domain expressed by two different anti-protein tyrosine kinase biomarker antibody-expressing cell lines.

Molecules comprising, or alternatively consisting of, antibody fragments or variants of the $V_H$ and/or $V_L$ domains expressed by an anti-protein tyrosine kinase biomarker antibody-expressing cell line that immunospecifically bind to a tyrosine kinase biomarker protein, e.g., Src tyrosine kinase, are also encompassed by the invention, as are nucleic acid molecules encoding these $V_H$ and $V_L$ domains, molecules, fragments and/or variants.

The present invention also provides antibodies that immunospecifically bind to a polypeptide, or polypeptide fragment or variant of a tyrosine kinase biomarker protein, e.g., a Src kinase biomarker protein, wherein such antibodies comprise, or alternatively consist of, a polypeptide having an amino acid sequence of any one, two, three, or more of the $V_H$ CDRs contained in a heavy chain expressed by one or more anti-tyrosine kinase biomarker protein antibody expressing cell lines. In particular, the invention provides antibodies that immunospecifically bind to a tyrosine kinase biomarker protein, comprising, or alternatively consisting of, a polypeptide having the amino acid sequence of a $V_H$ CDR1 contained in a heavy chain expressed by one or more anti-tyrosine kinase biomarker protein antibody expressing cell lines. In another embodiment, antibodies that immunospecifically bind to a tyrosine kinase biomarker protein, comprise, or alternatively consist of, a polypeptide having the amino acid sequence of a $V_H$ CDR2 contained in a heavy chain expressed by one or more anti-tyrosine kinase biomarker protein antibody expressing cell lines. In a preferred embodiment, antibodies that immunospecifically bind to a tyrosine kinase biomarker protein, comprise, or alternatively consist of, a polypeptide having the amino acid sequence of a $V_H$ CDR3 contained in a heavy chain expressed by one or more anti-tyrosine kinase biomarker protein antibody expressing cell line of the invention. Molecules comprising, or alternatively consisting of, these antibodies or antibody fragments or variants thereof that immunospecifically bind to a tyrosine kinase biomarker protein or a tyrosine kinase biomarker protein fragment or variant thereof are also encompassed by the invention, as are nucleic acid molecules encoding these antibodies, molecules, fragments and/or variants.

The present invention also provides antibodies that immunospecifically bind to a polypeptide, or polypeptide fragment or variant of a tyrosine kinase biomarker protein, e.g., a Src kinase biomarker protein, wherein the antibodies comprise, or alternatively consist of, a polypeptide having an amino acid sequence of any one, two, three, or more of the $V_L$ CDRs contained in a heavy chain expressed by one or more anti-tyrosine kinase biomarker protein antibody expressing cell lines of the invention. In particular, the invention provides antibodies that immunospecifically bind to a tyrosine kinase biomarker protein, comprising, or alternatively consisting of, a polypeptide having the amino acid sequence of a $V_L$ CDR1 contained in a heavy chain expressed by one or more anti-tyrosine kinase biomarker protein antibody-expressing cell lines of the invention. In another embodiment, antibodies that immunospecifically bind to a src biomarker protein, comprise, or alternatively consist of, a polypeptide having the amino acid sequence of a $V_L$ CDR2 contained in a heavy chain expressed by one or more anti-tyrosine kinase biomarker protein antibody-expressing cell lines of the invention. In a preferred embodiment, antibodies that immunospecifically bind to a tyrosine kinase biomarker protein, comprise, or alternatively consist of, a polypeptide having the amino acid sequence of a $V_L$ CDR3 contained in a heavy chain expressed by one or more anti-tyrosine kinase biomarker protein antibody-expressing cell lines of the invention. Molecules comprising, or alternatively consisting of, these antibodies, or antibody fragments or variants thereof, that immunospecifically bind to a tyrosine kinase biomarker protein or a tyrosine kinase biomarker protein fragment or variant thereof are also encompassed by the invention, as are nucleic acid molecules encoding these antibodies, molecules, fragments and/or variants.

The present invention also provides antibodies (including molecules comprising, or alternatively consisting of, antibody fragments or variants) that immunospecifically bind to a tyrosine kinase biomarker protein, polypeptide or polypeptide fragment or variant of a tyrosine kinase biomarker protein, e.g., Src tyrosine kinase, wherein the antibodies comprise, or alternatively consist of, one, two, three, or more $V_H$ CDRs, and one, two, three or more $V_L$ CDRs, as contained in a heavy chain or light chain expressed by one or more anti-tyrosine kinase biomarker protein antibody-expressing cell lines of the invention. In particular, the invention provides antibodies that immunospecifically bind to a polypeptide or polypeptide fragment or variant of a tyrosine kinase biomarker protein, wherein the antibodies comprise, or alternatively consist of, a $V_H$ CDR1 and a $V_L$ CDR1, a $V_H$ CDR1 and a $V_L$ CDR2, a $V_H$ CDR1 and a $V_L$ CDR3, a $V_H$ CDR2 and a $V_L$ CDR1, VH CDR2 and $V_L$ CDR2, a $V_H$ CDR2 and a $V_L$ CDR3, a $V_H$ CDR3 and a $V_H$ CDR1, a $V_H$ CDR3 and a $V_L$ CDR2, a $V_H$ CDR3 and a $V_L$ CDR3, or any combination thereof, of the $V_H$ CDRs and $V_L$ CDRs contained in a heavy chain or light chain immunoglobulin molecule expressed by one or more anti-tyrosine kinase biomarker protein antibody-expressing cell lines of the invention. In a preferred embodiment, one or more of these combinations are from a single anti-tyrosine kinase biomarker protein antibody-expressing cell line of the invention. Molecules comprising, or alternatively consisting of, fragments or variants of these antibodies that immunospecifically bind to the tyrosine kinase biomarker proteins are also encompassed by the invention, as are nucleic acid molecules encoding these antibodies, molecules, fragments or variants.

The present invention also provides nucleic acid molecules, generally isolated, encoding an antibody of the invention (including molecules comprising, or alternatively consisting of, antibody fragments or variants thereof). In a specific embodiment, a nucleic acid molecule of the invention encodes an antibody (including molecules comprising, or alternatively consisting of, antibody fragments or variants thereof), comprising, or alternatively consisting of, a $V_H$ domain having an amino acid sequence of any one of the $V_H$ domains of a heavy chain expressed by an anti-tyrosine kinase biomarker protein antibody-expressing cell line of the invention and a $V_L$ domain having an amino acid sequence of a light chain expressed by an anti-tyrosine kinase biomarker protein antibody-expressing cell line of the invention. In another embodiment, a nucleic acid molecule of the invention encodes an antibody (including molecules comprising, or alternatively consisting of, antibody fragments or variants thereof), comprising, or alternatively consisting of, a $V_H$ domain having an amino acid sequence of any one of the $V_H$ domains of a heavy chain expressed by an anti-tyrosine kinase biomarker protein antibody-expressing cell line of the invention, or a $V_L$ domain having an amino acid sequence of a light chain expressed by an anti-tyrosine kinase biomarker protein antibody-expressing cell line of the invention.

The present invention also provides antibodies that comprise, or alternatively consist of, variants (including derivatives) of the antibody molecules (e.g., the $V_H$ domains and/or $V_L$ domains) described herein, which antibodies immunospecifically bind to a tyrosine kinase biomarker protein or fragment or variant thereof, e.g., a Src tyrosine kinase polypeptide.

Standard techniques known to those of skill in the art can be used to introduce mutations in the nucleotide sequence encoding a molecule of the invention, including, for example, site-directed mutapolynucleotidesis and PCR-mediated mutapolynucleotidesis which result in amino acid substitutions. Preferably the molecules are immunoglobulin molecules. Also preferably, the variants (including derivatives) encode less than 50 amino acid substitutions, less than 40 amino acid substitutions, less than 30 amino acid substitutions, less than 25 amino acid substitutions, less than 20 amino acid substitutions, less than 15 amino acid substitutions, less than 10 amino acid substitutions, less than 5 amino acid substitutions, less than 4 amino acid substitutions, less than 3 amino acid substitutions, or less than 2 amino acid substitutions, relative to the reference $V_H$ domain, $V_H$ CDR1, $V_H$ CDR2, $V_H$ CDR3, $V_L$ domain, $V_L$ CDR1, $V_L$ CDR2, or $V_L$ CDR3.

A "conservative amino acid substitution" is one in which the amino acid residue is replaced with an amino acid residue having a side chain with a similar charge. Families of amino acid residues having side chains with similar charges have been defined in the art. These families include amino acids with basic side chains (e.g., lysine, arginine, histidine), acidic side chains (e.g., aspartic acid, glutamic acid), uncharged polar side chains (e.g., glycine, asparagine, glutaminie, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine). Alternatively, mutations can be introduced randomly along all or part of the coding sequence, such as by saturation mutapolynucleotidesis. The resultant mutants can be screened for biological activity to identify mutants that retain activity.

For example, it is possible to introduce mutations only in framework regions or only in CDR regions of an antibody molecule. Introduced mutations can be silent or neutral missense mutations, i.e., have no, or little, effect on an antibody's ability to bind antigen. These types of mutations can be useful to optimize codon usage, or to improve hybridoma antibody production. Alternatively, non-neutral missense mutations can alter an antibody's ability to bind antigen. The location of most silent and neutral missense mutations is likely to be in the framework regions, while the location of most non-neutral missense mutations is likely to be in the CDRs, although this is not an absolute requirement. One of skill in the art is able to design and test mutant molecules with desired properties, such as no alteration in antigen binding activity or alteration in binding activity (e.g., improvements in antigen binding activity or change in antibody specificity). Following mutapolynucleotidesis, the encoded protein may routinely be expressed and the functional and/or biological activity of the encoded protein can be determined using techniques described herein or by routinely modifying techniques known and practiced in the art.

In a specific embodiment, an antibody of the invention (including a molecule comprising, or alternatively consisting of, an antibody fragment or variant thereof), that immunospecifically binds to protein tyrosine kinase biomarker polypeptides or fragments or variants thereof, comprises, or alternatively consists of, an amino acid sequence encoded by a nucleotide sequence that hybridizes to a nucleotide sequence that is complementary to that encoding one of the $V_H$ or $V_L$ domains expressed by one or more anti-tyrosine kinase biomarker protein antibody-expressing cell lines of the invention, preferably under stringent conditions, e.g., hybridization to filter-bound DNA in 6× sodium chloride/sodium citrate (SSC) at about 45° C. followed by one or more washes in 0.2×SSC/0.1% SDS at about 50° C.-65° C., preferably under highly stringent conditions, e.g., hybridization to filter-bound nucleic acid in 6×SSC at about 45° C. followed by one or more washes in 0.1×SSC/0.2% SDS at about 68° C., or under other stringent hybridization conditions which are known to those of skill in the art (see, for example, Ausubel, F. M. et al., eds., 1989, Current Protocols in Molecular Biology, Vol. I, Green Publishing Associates, Inc. and John Wiley & Sons, Inc., New York at pages 6.3.1-6.3.6 and 2.10.3). Nucleic acid molecules encoding these antibodies are also encompassed by the invention.

It is well known within the art that polypeptides, or fragments or variants thereof, with similar amino acid sequences often have similar structure and many of the same biological activities. Thus, in one embodiment, an antibody (including a molecule comprising, or alternatively consisting of, an antibody fragment or variant thereof), that immunospecifically binds to a protein tyrosine kinase biomarker polypeptide or fragments or variants of a tyrosine kinase biomarker polypeptide, comprises, or alternatively consists of, a $V_H$ domain having an amino acid sequence that is at least 35%, at least 40%, at least 45%, at least 50%, at least 55%, at least 60%, at least 65%, at least 70%, at least 75%, at least 80%, at least 85%, at least 90%, at least 95%, or at least 99% identical to the amino acid sequence of a $V_H$ domain of a heavy chain expressed by an anti-tyrosine kinase biomarker protein antibody-expressing cell line of the invention.

In another embodiment, an antibody (including a molecule comprising, or alternatively consisting of, an antibody fragment or variant thereof), that immunospecifically binds to a tyrosine kinase biomarker polypeptide, or fragments or variants of a tyrosine kinase biomarker protein polypeptide, comprises, or alternatively consists of, a $V_L$ domain having an amino acid sequence that is at least 35%, at least 40%, at least 45%, at least 50%, at least 55%, at least 60%, at least 65%, at least 70%, at least 75%, at least 80%, at least 85%, at least 90%, at least 95%, or at least 99% identical to the amino acid sequence of a $V_L$ domain of a light chain expressed by an anti-tyrosine kinase biomarker protein antibody-expressing cell line of the invention.

The present invention also provides antibodies (including molecules comprising, or alternatively consisting of, antibody fragments or variants thereof), that down-regulate the cell-surface expression of a tyrosine kinase biomarker protein, as determined by any method known in the art such as, for example, FACS analysis or immunofluorescence assays. By way of a non-limiting hypothesis, such down-regulation can be the result of antibody-induced internalization of a tyrosine kinase biomarker protein. Such antibodies can comprise, or alternatively consist of, a portion (e.g., $V_H$CDR1, $V_H$CDR2, $V_H$CDR3, $V_L$CDR1, $V_L$CDR2, or $V_L$CDR3) of a $V_H$ or $V_L$ domain having an amino acid sequence of an antibody of the invention, or a fragment or variant thereof.

In another embodiment, an antibody that down-regulates the cell-surface expression of a tyrosine kinase biomarker protein comprises, or alternatively consists of, a polypeptide having the amino acid sequence of a $V_H$ domain of an antibody of the invention, or a fragment or variant thereof and a $V_L$ domain of an antibody of the invention, or a fragment or variant thereof. In another embodiment, an antibody that down-regulates the cell-surface expression of a tyrosine kinase biomarker protein comprises, or alternatively consists of, a polypeptide having the amino acid sequence of a $V_H$ domain and a $V_L$ domain from a single antibody (or scFv or Fab fragment) of the invention, or fragments or variants thereof. In another embodiment, an antibody that down-regulates the cell-surface expression of a tyrosine kinase biomarker protein comprises, or alternatively consists of, a polypeptide having the amino acid sequence of a $V_H$ domain of an antibody of the invention, or a fragment or variant thereof. In another embodiment, an antibody that down-regulates the cell-surface expression of a tyrosine kinase biomarker protein comprises, or alternatively consists of, a polypeptide having the amino acid sequence of a $V_L$ domain of an antibody of the invention, or a fragment or variant thereof.

In a preferred embodiment, an antibody that down-regulates the cell-surface expression of a tyrosine kinase biomarker protein comprises, or alternatively consists of, a polypeptide having the amino acid sequence of a $V_H$ CDR3 of an antibody of the invention, or a fragment or variant thereof. In another preferred embodiment, an antibody that down-regulates the cell-surface expression of a tyrosine kinase biomarker protein comprises, or alternatively consists of, a polypeptide having the amino acid sequence of a $V_L$ CDR3 of an antibody of the invention, or a fragment or variant thereof. Nucleic acid molecules encoding these antibodies are also encompassed by the invention.

In another preferred embodiment, an antibody that enhances the activity of a tyrosine kinase biomarker protein, or a fragment or variant thereof, comprises, or alternatively consists of, a polypeptide having the amino acid sequence of a $V_L$ CDR3 of an antibody of the invention, or a fragment or variant thereof. Nucleic acid molecules encoding these antibodies are also encompassed by the invention.

As nonlimiting examples, antibodies of the present invention can be used to purify, detect, and target the protein tyrosine kinase polypeptides of the present invention, including both in vitro and in vivo diagnostic, detection, screening, and/or therapeutic methods. For example, the antibodies have been used in immunoassays for qualitatively and quantitatively measuring levels of src biomarker polypeptides in biological samples. (See, e.g., Harlow et al., *Antibodies: A Laboratory Manual*, Cold Spring Harbor Laboratory Press, 2nd Ed. 1988, which is incorporated by reference herein in its entirety).

By way of another nonlimiting example, antibodies of the invention can be administered to individuals as a form of passive immunization. Alternatively, antibodies of the present invention can be used for epitope mapping to identify the epitope(s) that are bound by the antibody. Epitopes identified in this way can, in turn, for example, be used as vaccine candidates, i.e., to immunize an individual to elicit antibodies against the naturally-occurring forms of one or more tyrosine kinase biomarker proteins.

As discussed in more detail below, the antibodies of the present invention can be used either alone or in combination with other compositions. The antibodies can further be recombinantly fused to a heterologous polypeptide at the N-or C-terminus, or chemically conjugated (including covalent and non-covalent conjugations) to polypeptides or other compositions. For example, antibodies of the present invention can be recombinantly fused or conjugated to molecules that are useful as labels in detection assays and to effector molecules such as heterologous polypeptides, drugs, radionuclides, or toxins. See, e.g., PCT publications WO 92/08495; WO 91/14438; WO 89/12624; U.S. Pat. No. 5,314,995 and EP 396, 387.

The antibodies of the invention include derivatives that are modified, i.e., by the covalent attachment of any type of molecule to the antibody. For example, without limitation, the antibody derivatives include antibodies that have been modified, e.g., by glycosylation, acetylation, pegylation, phosphorylation, amidation, derivatization by known protecting/blocking groups, proteolytic cleavage, linkage to a cellular ligand or other protein, etc. Any of numerous chemical modifications can be carried out by known techniques, including, but not limited to, specific chemical cleavage, acetylation, formylation, metabolic synthesis of tunicamycin, and the like. In addition, the antibody derivative can contain one or more non-classical amino acids.

The antibodies of the present invention can be generated by any suitable method known in the art. Polyclonal antibodies directed against an antigen or immunogen of interest can be produced by various procedures well known in the art. For example, a tyrosine kinase biomarker polypeptide or peptide of the invention can be administered to various host animals as elucidated above to induce the production of sera containing polyclonal antibodies specific for the biomarker antigen. Various adjuvants can also be used to increase the immunological response, depending on the host species; adjuvants include, but are not limited to, Freund's (complete and incomplete), mineral gels such as aluminum hydroxide, surface active substances such as lysolecithin, pluronic polyols, polyanions, peptides, oil emulsions, keyhole limpet hemocyanins, dinitrophenol, and potentially useful human adjuvants such as BCG (bacille Calmette-Guerin) and corynebacterium parvum. Such adjuvants are also well known in the art.

Monoclonal antibodies can be prepared using a wide variety of techniques known in the art, including the use of hybridoma, recombinant and phage display technologies, or a combination thereof. For example, monoclonal antibodies can be produced using hybridoma techniques as known and practiced in the art and as taught, for example, in Kohler and Milstein, 1975, *Nature,* 256:495-497; Harlow et al., Antibodies: A Laboratory Manual, Cold Spring Harbor Laboratory Press, 2nd Ed. 1988; and Hammerling, et al., In: Monoclonal Antibodies and T-Cell Hybridomas, Elsevier, N.Y., pages 563-681, 1981, the contents of which are incorporated herein by reference in their entireties. The term "monoclonal antibody" as used herein is not limited to antibodies produced through hybridoma technology. The term "monoclonal antibody" refers to an antibody that is derived from a single clone, including any eukaryotic, prokaryotic, or phage clone, and does not necessarily refer to the method by which it is produced. Techniques involving continuous cell line cultures can also be used. In addition to the hybridoma technique, other techniques include the trioma technique, the human B-cell hybridoma technique (Kozbor et al., 1983, *Immunol. Today,* 4:72), and the EBV-hybridoma technique (Cole et al., 1985. In: *Monoclonal Antibodies and Cancer Therapy*, Alan R. Liss, Inc., pp. 77-96).

Methods for producing and screening for specific antibodies using hybridoma technology are routine and well known in the art. As a nonlimiting example, mice can be immunized with a tyrosine kinase polypeptide or peptide of the invention, or variant thereof, or with a cell expressing the polypeptide or peptide or variant thereof. Once an immune response is detected, e.g., antibodies specific for the antigen are detected in the sera of immunized mice, the spleen is harvested and splenocytes are isolated. The splenocytes are then fused by well known techniques to any suitable myeloma cells, for example cells from cell line SP2/0 or P3X63-AG8.653 available from the ATCC. Hybridomas are selected and cloned by limiting dilution techniques. The hybridoma clones are then assayed by methods known in the art to determine and select those cells that secrete antibodies capable of binding to a polypeptide of the invention. Ascites fluid, which generally contains high levels of antibodies, can be generated by immunizing mice with positive hybridoma clones.

Another well known method for producing both polyclonal and monoclonal human B cell lines is transformation using Epstein Barr Virus (EBV). Protocols for generating EBV-transformed B cell lines are commonly known in the art, such as, for example, the protocol outlined in Chapter 7.22 of *Current Protocols in Immunology,* Coligan et al., Eds., 1994, John Wiley & Sons, NY, which is hereby incorporated by reference herein in its entirety. The source of B cells for transformation is commonly human peripheral blood, but B cells for transformation can also be obtained from other sources including, but not limited to, lymph node, tonsil, spleen, tumor tissue, and infected tissues. Tissues are generally prepared as single cell suspensions prior to EBV transformation. In addition, T cells that may be present in the B cell samples can be either physically removed or inactivated (e.g., by treatment with cyclosporin A). The removal of T cells is often advantageous, because T cells from individuals seropositive for anti-EBV antibodies can suppress B cell immortalization by EBV. In general, a sample containing human B cells is innoculated with EBV and cultured for 3-4 weeks. A typical source of EBV is the culture supernatant of the B95-8 cell line (ATCC; VR-1492). Physical signs of EBV transformation can generally be seen toward the end of the 3-4 week culture period.

By phase-contrast microscopy, transformed cells appear large, clear and "hairy"; they tend to aggregate in tight clusters of cells. Initially, EBV lines are generally polyclonal. However, over prolonged periods of cell culture, EBV lines can become monoclonal as a result of the selective outgrowth of particular B cell clones. Alternatively, polyclonal EBV transformed lines can be subcloned (e.g., by limiting dilution) or fused with a suitable fusion partner and plated at limiting dilution to obtain monoclonal B cell lines. Suitable fusion partners for EBV transformed cell lines include mouse myeloma cell lines (e.g., SP2/0, X63-Ag8.653), heteromyeloma cell lines (human×mouse; e.g., SPAM-8, SBC-H20, and CB-F7), and human cell lines (e.g., GM 1500, SKO-007, RPMI 8226, and KR-4). Thus, the present invention also includes a method of generating polyclonal or monoclonal human antibodies against protein tyrosine kinase polypeptides and peptides of the invention, or fragments thereof, comprising EBV-transformation of human B cells.

Antibody fragments that recognize specific epitopes can be generated by known techniques. For example, Fab and F(ab')2 fragments of the invention can be produced by proteolytic cleavage of immunoglobulin molecules, using enzymes such as papain (to produce Fab fragments) or pepsin (to produce F(ab')2 fragments). F(ab')2 fragments contain the variable region, the light chain constant region and the CH1 domain of the heavy chain.

Antibodies encompassed by the present invention can also be generated using various phage display methods known in the art. In phage display methods, functional antibody domains are displayed on the surface of phage particles which carry the polynucleotide sequences encoding them. In a particular embodiment, such phage can be utilized to display antigen binding domains expressed from a repertoire or combinatorial antibody library (e.g., human or murine). Phage expressing an antigen binding domain that binds to the antigen of interest can be selected or identified with antigen, e.g., using labeled antigen or antigen bound or captured onto a solid surface or bead. Phage used in these methods are typically filamentous phage including fd and M13 binding domains expressed from phage with Fab, Fv, or disulfide stabilized antibody domains recombinantly fused to either the phage polynucleotide III or polynucleotide VIII protein. Examples of phage display methods that can be used to make the antibodies of the present invention include those disclosed in Brinkman et al., 1995, *J. Immunol. Methods*, 182:41-50; Ames et al., 1995, *J. Immunol. Methods*, 184:177-186; Kettleborough et al., 1994, *Eur. J. Immunol.*, 24:952-958; Persic et al., 1997, *Gene*, 187:9-18; Burton et al., 1994, *Advances in Immunology*, 57:191-280; PCT application No. PCT/GB91/01134; PCT publications WO 90/02809; WO 91/10737; WO 92/01047; WO 92/18619; WO 93/11236; WO 95/15982; WO 95/20401; and U.S. Pat. Nos. 5,698,426; 5,223,409; 5,403,484; 5,580,717; 5,427,908; 5,750,753; 5,821,047; 5,571,698; 5,427,908; 5,516,637; 5,780,225; 5,658,727; 5,733,743 and 5,969,108, each of which is incorporated herein by reference in its entirety.

As described in the above references, after phage selection, the antibody coding regions from the phage can be isolated and used to generate whole antibodies, including human antibodies, or any other desired antigen binding fragment, and expressed in any desired host, including mammalian cells, insect cells, plant cells, yeast, and bacteria, e.g., as described in detail below.

Examples of techniques that can be used to produce single-chain Fvs and antibodies include those described in U.S. Pat. Nos. 4,946,778 and 5,258,498; Huston et al., 1991, *Methods in Enzymology*, 203:46-88; Shu et al., 1993, *Proc. Natl. Acad. Sci. USA*, 90:7995-7999; and Skerra et al., 1988, *Science*, 240:1038-1040. For some uses, including the in vivo use of antibodies in humans and in in vitro detection assays, it may be preferable to use chimeric, humanized, or human antibodies. A chimeric antibody is a molecule in which different portions of the antibody are derived from different animal species, such as antibodies having a variable region derived from a murine monoclonal immunoglobulin and a human immunoglobulin constant region. Methods for producing chimeric antibodies are known in the art. (See, e.g., Morrison, 1985, *Science*, 229:1202; Oi et al., 1986, *BioTechniques*, 4:214; Gillies et al., 1989, *J. Immunol. Methods*, 125:191-202; and U.S. Pat. Nos. 5,807,715; 4,816,567; and 4,816,397, which are incorporated herein by reference in their entirety).

Humanized antibodies are antibody molecules from non-human species that bind to the desired antigen and have one or more complementarity determining regions (CDRs) from the nonhuman species and framework regions from a human immunoglobulin molecule. Often, framework residues in the human framework regions are substituted with corresponding residues from the CDR and framework regions of the donor antibody to alter, preferably improve, antigen binding. These framework substitutions are identified by methods well known in the art, e.g., by modeling of the interactions of the CDR and framework residues to identify framework residues important for antigen binding, and by sequence comparison to identify unusual framework residues at particular positions. (See, e.g., Queen et al., U.S. Pat. Nos. 5,693,762 and 5,585,089; and Riechmann et al., 1988, *Nature*, 332:323, which are incorporated herein by reference in their entireties).

Antibodies can be humanized using a variety of techniques known in the art, including, for example, CDR-grafting (EP 239,400; PCT publication WO 91/09967; U.S. Pat. Nos. 5,225,539; 5,530,101; and 5,585,089); veneering or resurfacing (EP 592,106; EP 519,596; Padlan, 1991, *Molecular Immunology*, 28(4/5):489-498; Studnicka et al., 1994, *Protein Engineering*, 7(6):805-814; Roguska et al., 1994, *Proc. Natl. Acad. Sci. USA*, 91:969-973; and chain shuffling (U.S. Pat. No. 5,565,332).

Completely human antibodies can be made by a variety of methods known in the art, including the phage display methods described above, using antibody libraries derived from human immunoglobulin sequences. See also, U.S. Pat. Nos. 4,444,887 and 4,716,111; and PCT publications WO 98/46645, WO 98/50433, WO 98/24893, WO 98/16654, WO 96/34096, WO 96/33735, and WO 91/10741; each of which is incorporated herein by reference in its entirety.

Completely human antibodies are particularly desirable for therapeutic treatment of human patients, so as to avoid or alleviate immune reaction to foreign protein. Human antibodies can be made by a variety of methods known in the art, including the phage display methods described above, using antibody libraries derived from human immunoglobulin sequences. See also, U.S. Pat. Nos. 4,444,887 and 4,716,111; and PCT publications WO 98/46645, WO 98/50433, WO 98/24893, WO 98/16654, WO 96/34096, WO 96/33735, and WO 91/10741; each of which is incorporated herein by reference in its entirety.

Human antibodies can also be produced using transgenic mice which are incapable of expressing functional endogenous immunoglobulins, but which can express human immunoglobulin polynucleotides. For example, the human heavy and light chain immunoglobulin polynucleotide complexes can be introduced randomly, or by homologous recombination, into mouse embryonic stem cells. Alternatively, the human variable region, constant region, and diversity region may be introduced into mouse embryonic stem cells, in addition to the human heavy and light chain polynucleotides. The mouse heavy and light chain immunoglobulin polynucleotides can be rendered nonfunctional separately or simultaneously with the introduction of human immunoglobulin loci by homologous recombination. In particular, homozygous deletion of the $J_H$ region prevents endogenous antibody production. The modified embryonic stem cells are expanded and microinjected into blastocysts to produce chimeric mice. The chimeric mice are then bred to produce homozygous offspring which express human antibodies. The transgenic mice are immunized in the normal fashion with a selected antigen, e.g., all or a portion of a polypeptide of the invention.

Thus, using such a technique, it is possible to produce useful human IgG, IgA, IgM, IgD and IgE antibodies. For an overview of the technology for producing human antibodies, see Lonberg and Huszar, 1995, *Intl. Rev. Immunol.*, 13:65-93. For a detailed discussion of the technology for producing human antibodies and human monoclonal antibodies and protocols for producing such antibodies, see, e.g., PCT publications WO 98/24893; WO 92/01047; WO 96/34096; WO 96/33735; European Patent No. 0 598 877; U.S. Pat. Nos. 5,413,923; 5,625,126; 5,633,425; 5,569,825; 5,661,016; 5,545,806; 5,814,318; 5,885,793; 5,916,771; 5,939,598; 6,075,181; and 6,114,598, which are incorporated by reference herein in their entirety. In addition, companies such as Abgenix, Inc. (Fremont, Calif.), Protein Design Labs, Inc. (Mountain View, Calif.) and Genpharm (San Jose, Calif.) can be engaged to provide human antibodies directed against a selected antigen using technology similar to the above described technologies.

Completely human antibodies which recognize a selected epitope can be generated using a technique referred to as "guided selection". In this approach, a selected non-human monoclonal antibody, e.g., a mouse antibody, is used to guide the selection of a completely human antibody recognizing the same epitope. (Jespers et al., 1988, *BioTechnology,* 12:899-903).

Further, antibodies to the protein tyrosine kinase polypeptides of the invention can, in turn, be utilized to generate anti-idiotypic antibodies that "mimic" protein tyrosine kinase biomarker polypeptides of the invention using techniques well known to those skilled in the art. (See, e.g., Greenspan and Bona, 1989, *FASEB J.,* 7(5):437-444and Nissinoff, 1991, *J. Immunol.,* 147(8):2429-2438). For example, antibodies which bind to and competitively inhibit polypeptide multimerization and/or binding of a polypeptide of the invention to a ligand can be used to generate anti-idiotypes that "mimic" the polypeptide multimerization and/or binding domain and, as a consequence, bind to and neutralize the polypeptide and/or its ligand, e.g., in therapeutic regimens. Such neutralizing anti-idiotypes or Fab fragments of such anti-idiotypes can be used to neutralize polypeptide ligand. For example, such anti-idiotypic antibodies can be used to bind a polypeptide of the invention and/or to bind its ligands/receptors, and thereby activate or block its biological activity.

Intrabodies are antibodies, often scFvs, that are expressed from a recombinant nucleic acid molecule and are engineered to be retained intracellularly (e.g., retained in the cytoplasm, endoplasmic reticulum, or periplasm of the host cells). Intrabodies can be used, for example, to ablate the function of a protein to which the intrabody binds. The expression of intrabodies can also be regulated through the use of inducible promoters in the nucleic acid expression vector comprising nucleic acid encoding the intrabody. Intrabodies of the invention can be produced using methods known in the art, such as those disclosed and reviewed in Chen et al., 1994, *Hum. Polynucleotide Ther.,* 5:595-601; Marasco, W. A., 1997, *Polynucleotide Ther.,* 4:11-15; Rondon and Marasco, 1997, *Annu. Rev. Microbiol.,* 51:257-283; Proba et al., 1998, *J. Mol. Biol.,* 275:245-253; Cohen et al., 1998, *Oncogene,* 17:2445-256; Ohage and Steipe, 1999, *J. Mol. Biol.,* 291:1119-1128; Ohage et al., 1999, *J. Mol. Biol.,* 291:1129-1134; Wirtz and Steipe, 1999, *Protein Sci.,* 8:2245-2250; and Zhu et al., 1999, *J. Immunol. Methods,* 231:207-222.

XenoMouse Technology Antibodies in accordance with the invention are preferably prepared by the utilization of a transgenic mouse that has a substantial portion of the human antibody producing genome inserted into its genome, but that is rendered deficient in the production of endogenous murine antibodies (e.g., XenoMouse strains available from Abgenix Inc., Fremont, Calif.). Such mice are capable of producing human immunoglobulin molecules and are virtually deficient in the production of murine immunoglobulin molecules. Technologies utilized for achieving the same are disclosed in the patents, applications, and references disclosed herein.

The ability to clone and reconstruct megabase-sized human loci in YACs and to introduce them into the mouse germline provides a powerful approach to elucidating the functional components of very large or crudely mapped loci, as well as generating useful models of human disease. Furthermore, the utilization of such technology for substitution of mouse loci with their human equivalents could provide unique insights into the expression and regulation of human polynucleotide products during development, their communication with other systems, and their involvement in disease induction and progression. An important practical application of such a strategy is the "humanization" of the mouse humoral immune system. Introduction of human immunoglobulin (Ig) loci into mice in which the endogenous Ig polynucleotides have been inactivated offers the opportunity to study the mechanisms underlying programmed expression and assembly of antibodies as well as their role in B cell development. Furthermore, such a strategy could provide an ideal source for the production of fully human monoclonal antibodies (Mabs), which is an important milestone toward fulfilling the promise of antibody therapy in human disease.

Fully human antibodies are expected to minimize the immunogenic and allergic responses intrinsic to mouse or mouse-derivatized monoclonal antibodies and thus to increase the efficacy and safety of the administered antibodies. The use of fully human antibodies can be expected to provide a substantial advantage in the treatment of chronic and recurring human diseases, such as cancer, which require repeated antibody administrations.

One approach toward this goal was to engineer mouse strains deficient in mouse antibody production to harbor large fragments of the human Ig loci in anticipation that such mice would produce a large repertoire of human antibodies in the absence of mouse antibodies. Large human Ig fragments would preserve the large variable polynucleotide diversity as well as the proper regulation of antibody production and expression. By exploiting the mouse machinery for antibody diversification and selection and the lack of immunological tolerance to human proteins, the reproduced human antibody repertoire in these mouse strains should yield high affinity antibodies against any antigen of interest, including human antigens. Using the hybridoma technology, antigen-specific human monoclonal antibodies with the desired specificity could be readily produced and selected.

This general strategy was demonstrated in connection with the generation of the first "XenoMouseT" strains as published in 1994. See Green et al., 1994, *Nature Genetics,* 7:13-21. The XenoMouse strains were engineered with yeast artificial chromosomes (YACS) containing 245 kb and 10, 190 kb-sized germline configuration fragments of the human heavy chain locus and kappa light chain locus, respectively, which contained core variable and constant region sequences. Id. The human Ig-containing YACs proved to be compatible with the mouse system for both rearrangement and expression of antibodies and were capable of substituting for the inactivated mouse Ig polynucleotides. This was demonstrated by their ability to induce B-cell development, to produce an adult-like human repertoire of fully human antibodies, and to generate antigen-specific human monoclonal antibodies. These results also suggested that introduction of larger portions of the human Ig loci containing greater numbers of V polynucleotides, additional regulatory elements, and human Ig constant regions might recapitulate substantially the full repertoire that is characteristic of the human humoral response to infection and immunization. The work of Green et al. was recently extended to the introduction of greater than approximately 80% of the human antibody repertoire through the use of megabase-sized, germline configuration YAC fragments of the human heavy chain loci and kappa light chain loci, respectively, to produce XenoMouse mice. See Mendez et al., 1997, *Nature Genetics,* 15:146-156; Green and Jakobovits, 1998, *J. Exp. Med.,* 188:483-495; and Green, 1999, *Journal of Immunological Methods,* 231:11-23, the disclosures of which are hereby incorporated herein by reference.

Human anti-mouse antibody (HAMA) responses have led the industry to prepare chimeric or otherwise humanized antibodies. While chimeric antibodies typically are comprised of a human constant region and a murine variable region, it is expected that certain human anti-chimeric antibody (HACA) responses will be observed, particularly in treatments involving chronic or multi-dose utilizations of the antibody. Thus, it is desirable to provide fully human antibodies against protein tyrosine kinase biomarker polypeptides in order to vitiate concerns and/or effects of HAMA or HACA responses.

Antibodies of the invention can be chemically synthesized or produced through the use of recombinant expression systems. Accordingly, the invention further embraces polynucleotides comprising a nucleotide sequence encoding an antibody of the invention and fragments thereof. The invention also encompasses polynucleotides that hybridize under stringent or lower stringency hybridization conditions, e.g., as defined supra, to polynucleotides that encode an antibody, preferably, an antibody that specifically binds to a protein tyrosine kinase polypeptide of this invention, and more preferably, an antibody that binds to a polypeptide having the amino acid sequence of one or more of the protein tyrosine kinase biomarker sequences, e.g., Src tyrosine kinase biomarkers, as set forth in Table 2.

The polynucleotides may be obtained, and the nucleotide sequence of the polynucleotides determined, by any method known in the art. For example, if the nucleotide sequence of the antibody is known, a polynucleotide encoding the antibody can be assembled from chemically synthesized oligonucleotides (e.g., as described in Kutmeier et al., 1994, *BioTechniques,* 17:242), which, briefly, involves the synthesis of overlapping oligonucleotides containing portions of the sequence encoding the antibody, the annealing and ligating of those oligonucleotides, and then the amplification of the ligated oligonucleotides by PCR.

Alternatively, a polynucleotide encoding an antibody can be generated from nucleic acid from a suitable source. If a clone containing a nucleic acid encoding a particular antibody is not available, but the sequence of the antibody molecule is known, a nucleic acid encoding the immunoglobulin can be chemically synthesized or obtained from a suitable source (e.g., an antibody cDNA library, or a cDNA library generated from, (or a nucleic acid, preferably poly A+ RNA, isolated from), any tissue or cells expressing the antibody, such as hybridoma cells selected to express an antibody of the invention by PCR amplification using synthetic primers hybridizable to the 3' and 5' ends of the sequence. Alternatively, cloning using an oligonucleotide probe specific for the particular polynucleotide sequence to be identified, e.g., a cDNA clone from a cDNA library that encodes the desired antibody can be employed. Amplified nucleic acids generated by PCR can then be cloned into replicable cloning vectors using any method well known in the art.

Once the nucleotide sequence and corresponding encoded amino acid sequence of the antibody are determined, the nucleotide sequence of the antibody can be manipulated using methods well known in the art for the manipulation of nucleotide sequences, e.g., recombinant DNA techniques, site directed mutapolynucleotidesis, PCR, etc. (see, for example, the techniques described in Sambrook et al., 1990, *Molecular Cloning, A Laboratory Manual,* 2nd Ed., Cold Spring Harbor Laboratory, Cold Spring Harbor, N.Y.; and F. M. Ausubel et al., eds., 1998, *Current Protocols in Molecular Biology,* John Wiley & Sons, NY, which are both incorporated by reference herein in their entireties), to generate antibodies having a different amino acid sequence, for example, to create amino acid substitutions, deletions, and/or insertions.

In a specific embodiment, the amino acid sequence of the heavy and/or light chain variable domains can be inspected to identify the sequences of the CDRs by methods that are well known in the art, e.g., by comparison to known amino acid sequences of other heavy and light chain variable regions, to determine the regions of sequence hypervariability. Using routine recombinant DNA techniques, one or more of the CDRs can be inserted within framework regions, e.g., into human framework regions, to humanize a non-human antibody, as described supra. The framework regions can be naturally occurring or consensus framework regions, and preferably, are human framework regions (see, e.g., Chothia et al., 1998, *J. Mol. Biol.,* 278:457-479, for a listing of human framework regions).

Preferably, the polynucleotide generated by the combination of the framework regions and CDRs encodes an antibody that specifically binds to a protein tyrosine kinase biomarker polypeptide of the invention. Also preferably, as discussed supra, one or more amino acid substitutions can be made within the framework regions; such amino acid substitutions are performed with the goal of improving binding of the antibody to its antigen, e.g., greater antibody binding affinity. In addition, such methods can be used to make amino acid substitutions or deletions of one or more variable region cysteine residues participating in an intrachain disulfide bond to generate antibody molecules lacking one or more intrachain disulfide bonds. Other alterations that can be made to the polynucleotide are encompassed by the present invention and are within the skill of the art.

For some uses, such as for in vitro affinity maturation of an antibody of the invention, it is useful to express the $V_H$ and $V_L$ domains of the heavy and light chains of one or more antibodies of the invention as single chain antibodies, or Fab fragments, in a phage display library using phage display methods as described supra. For example, the cDNAs encoding the $V_H$ and $V_L$ domains of one or more antibodies of the invention can be expressed in all possible combinations using a phage display library, thereby allowing for the selection of $V_H/V_L$ combinations that bind to the protein tyrosine kinase biomarker polypeptides according to the present invention with preferred binding characteristics such as improved affinity or improved off rates. In addition, $V_H$ and $V_L$ segments, particularly, the CDR regions of the $V_H$ and $V_L$ domains of one or more antibodies of the invention, can be mutated in vitro. Expression of $V_H$ and $V_L$ domains with "mutant" CDRs in a phage display library allows for the selection of $V_H/V_L$ combinations that bind to protein tyrosine kinase biomarkers, e.g., Src tyrosine kinase biomarker proteins, which are receptor polypeptides with preferred binding characteristics such as improved affinity or improved off rates.

Once an antibody molecule of the invention has been produced by an animal, chemically synthesized, or recombinantly expressed, it can be purified by any method known in the art for the purification of an immunoglobulin or polypeptide molecule, for example, by chromatography (e.g., ion exchange, affinity, particularly by affinity for the specific antigen, Protein A, and sizing column chromatography), centrifugation, differential solubility, or by any other standard technique for the purification of proteins. In addition, the antibodies of the present invention or fragments thereof can be fused to heterologous polypeptide sequences described herein or otherwise known in the art, to facilitate purification.

The present invention encompasses antibodies that are recombinantly fused or chemically conjugated (including both covalently and non-covalently conjugated) to a polypeptide (or portion thereof, preferably at least 10, 20, 30, 40, 50, 60, 70, 80, 90 or 100 amino acids of the polypeptide) of the present invention to generate fusion proteins. The fusion does not necessarily need to be direct, but can occur through linker sequences. The antibodies can be specific for antigens other than polypeptides (or portions thereof, preferably at least 10, 20, 30, 40, 50, 60, 70, 80, 90 or 100 amino acids of the polypeptide) of the present invention. For example, antibodies can be used to target the polypeptides of the present invention to particular cell types, either in vitro or in vivo, by fusing or conjugating the polypeptides of the present invention to antibodies specific for particular cell surface receptors.

The present invention further includes compositions comprising the protein tyrosine kinase biomarker polypeptides of the present invention fused or conjugated to antibody domains other than the variable region domain. For example, the polypeptides of the present invention can be fused or conjugated to an antibody Fc region, or portion thereof. The antibody portion fused to a polypeptide of the present invention can comprise the constant region, hinge region, CH1 domain, CH2 domain, CH3 domain, or any combination of whole domains or portions thereof. The polypeptides can also be fused or conjugated to the above antibody portions to form multimers. For example, Fc portions of immunoglobulin molecules fused to the polypeptides of the present invention can form dimers through disulfide bonding between the Fc portions. Higher multimeric forms can be made by fusing the polypeptides to portions of IgA and IgM. Methods for fusing or conjugating the polypeptides of the present invention to antibody portions are known in the art. (See, e.g., U.S. Pat. Nos. 5,336,603; 5,622,929; 5,359,046; 5,349,053; 5,447,851; 5,112,946; EP 307,434; EP 367,166; PCT publications WO 96/04388; WO 91/06570; Ashkenazi et al., 1991, *Proc. Natl. Acad. Sci. USA*, 88:10535-10539; Zheng et al., 1995, *J. Immunol.*, 154:5590-5600; and Vil et al., *Proc. Natl. Acad. Sci. USA*, 89:11337-11341, which are hereby incorporated by reference herein in their entireties).

As discussed supra, the polypeptides corresponding to a polypeptide, polypeptide fragment, or a variant of one or more of the protein tyrosine kinase biomarker amino acid sequences as set forth in Table 2 can be fused or conjugated to the above antibody portions to increase the in vivo half life of the polypeptides, or for use in immunoassays using methods known in the art. Further, the polypeptides corresponding to one or more of the protein tyrosine kinase biomarker, e.g., src biomarker, sequences as set forth in Table 2 can be fused or conjugated to the above antibody portions to facilitate purification. For guidance, chimeric proteins having the first two domains of the human CD4 polypeptide and various domains of the constant regions of the heavy or light chains of mammalian immunoglobulins have been described. (EP 394,827; Traunecker et al., 1988, *Nature*, 331:84-86). The polypeptides of the present invention fused or conjugated to an antibody, or portion thereof, having disulfide-linked dimeric structures (due to the IgG), for example, can also be more efficient in binding and neutralizing other molecules than the monomeric secreted protein or protein fragment alone. (Fountoulakis et al., 1995, *J. Biochem.*, 270:3958-3964). In many cases, the Fc portion in a fusion protein is beneficial in therapy, diagnosis, and/or screening methods, and thus can result in, for example, improved pharmacokinetic properties. (EP 232, 262 A). In drug discovery, for example, human proteins, such as huIL-5, have been fused with Fc portions for the purpose of high-throughput screening assays to identify antagonists of huIL-5. (See, Bennett et al., 1995, *J. Molecular Recognition*, 8:52-58; and Johanson et al., 1995, *J. Biol. Chem.*, 270:9459-9471). Alternatively, deleting the Fc portion after the fusion protein has been expressed, detected, and purified may be desired. For example, the Fc portion may hinder therapy and diagnosis if the fusion protein is used as an antigen for immunizations.

Moreover, the antibodies or fragments thereof of the present invention can be fused to marker sequences, such as a peptide, to facilitate their purification. In preferred embodiments, the marker amino acid sequence is a hexa-histidine peptide, such as the tag provided in a pQE vector (QIAGEN, Inc., Chatsworth, Calif.), among others, many of which are commercially available. As described in Gentz et al., 1989, *Proc. Natl. Acad. Sci. USA*, 86:821-824, for instance, hexa-histidine provides for convenient purification of the fusion protein. Other peptide tags useful for purification include, but are not limited to, the "HA" tag, which corresponds to an epitope derived from the influenza hemagglutinin (HA) protein (Wilson et al., 1984, *Cell*, 37:767) and the "flag" tag.

The present invention further encompasses antibodies or fragments thereof conjugated to a diagnostic or therapeutic agent. The antibodies can be used diagnostically to, for example, monitor the development or progression of a tumor as part of a clinical testing procedure, for example, to determine the efficacy of a given treatment regimen. Detection can be facilitated by coupling the antibody to a detectable substance. Nonlimiting examples of detectable substances include various enzymes, prosthetic groups, fluorescent materials, luminescent materials, bioluminescent materials, radioactive materials, positron emitting metals using various positron emission tomographies, and nonradioactive paramagnetic metal ions. The detectable substance can be coupled or conjugated either directly to the antibody (or fragment thereof) or indirectly, through an intermediate (such as, for example, a linker known in the art) using techniques known in the art. (See, for example, U.S. Pat. No. 4,741,900 for metal ions which can be conjugated to antibodies for use as diagnostics according to the present invention).

Nonlimiting examples of suitable enzymes include horseradish peroxidase, alkaline phosphatase, beta-galactosidase, or acetylcholinesterase. Nonlimiting examples of suitable prosthetic group complexes include streptavidin/biotin and avidin/biotin; nonlimiting examples of suitable fluorescent materials include umbelliferone, fluorescein, fluorescein isothiocyanate, rhodamine, dichlorotriazinylamine fluorescein, dansyl chloride or phycoerythrin; a nonlimiting example of a luminescent material includes luminol; nonlimiting examples of bioluminescent materials include luciferase, luciferin, and aequorin; and nonlimiting examples of suitable radioactive material include iodine ($^{125}$I, $^{131}$I), carbon ($^{14}$C), sulfur (3sus), tritium ($^{3}$H), indium ($^{111}$In and other radioactive isotopes of inidium), technetium ($^{99}$Tc, $^{99m}$Tc), thallium (20'Ti), gallium ($^{68}$Ga, $^{67}$Ga), palladium ($^{103}$Pd), molybdenum ($^{99}$Mo), xenon ($^{133}$Xe), fluorine ($^{19}$F), $^{153}$Sm, $^{177}$Lu, Gd, radioactive Pm, radioactive La, radioactive Yb, $^{166}$Ho, $^{90}$Y, radioactive Sc, radioactive Re, radioactive Re, $^{142}$Pr, $^{105}$Rh, and $^{97}$Ru.

In specific embodiments, the protein tyrosine kinase biomarker polypeptides of the invention are attached to macrocyclic chelators useful for conjugating radiometal ions, including, but not limited to, $^{111}$In, $^{177}$Lu, $^{90}$Y, $^{166}$Ho, and $^{153}$Sm, to polypeptides. In a preferred embodiment, the radiometal ion associated with the macrocyclic chelators attached to the protein tyrosine kinase biomarker polypeptides of the invention is $^{111}$In. In another preferred embodiment, the radiometal ion associated with the macrocyclic chelator attached to the protein tyrosine kinase biomarker polypeptides of the invention is $^{90}$Y. In specific embodiments, the macrocyclic chelator is 1,4,7,10-tetraazacyclododecane-N,N',N'',N'''-tetraacetic acid (DOTA). In other specific embodiments, the DOTA is attached to the protein tyrosine kinase biomarker polypeptides of the invention via a linker molecule.

Examples of linker molecules useful for conjugating DOTA to a polypeptide are commonly known in the art. (See, for example, DeNardo et al., 1998, *Clin. Cancer Res.*, 4(10):

2483-90; Peterson et al., 1999, *Bioconjug. Chem.,* 10(4):553-557; and Zimmerman et al, 1999, *Nucl. Med. Biol.,* 26(8): 943-950, which are hereby incorporated by reference in their entirety). In addition, U.S. Pat. Nos. 5,652,361 and 5,756,065, which disclose chelating agents that can be conjugated to antibodies and methods for making and using them, are hereby incorporated by reference in their entireties. Though U.S. Pat. Nos. 5,652,361 and 5,756,065 focus on conjugating chelating agents to antibodies, one skilled in the art can readily adapt the methods disclosed therein in order to conjugate chelating agents to other polypeptides.

Antibodies can also be attached to solid supports, which are particularly useful for immunoassays or purification of the target antigen. Such solid supports include, but are not limited to, glass, cellulose, polyacrylamide, nylon, polystyrene, polyvinyl chloride or polypropylene. Techniques for conjugating therapeutic moieties to antibodies are well known, see, e.g., Arnon et al., "Monoclonal Antibodies For Immunotargeting Of Drugs In Cancer Therapy", In: *Monoclonal Antibodies And Cancer Therapy,* Reisfeld et al. (eds.), pp. 243-56, Alan R. Liss, Inc., 1985; Hellstrom et al., "Antibodies For Drug Delivery", In: *Controlled Drug Delivery* (2nd Ed.), Robinson et al. (eds.), pp. 623-53, Marcel Deldcer, Inc., 1987; Thorpe, "Antibody Carriers Of Cytotoxic Agents In Cancer Therapy: A Review", In: *Monoclonal Antibodies '84: Biological And Clinical Applications,* Pinchera et al. (eds.), pp. 475-506, 1985; "Analysis, Results, And Future Prospective Of The Therapeutic Use Of Radiolabeled Antibody In Cancer Therapy", In: *Monoclonal Antibodies For Cancer Detection And Therapy,* Baldwin et al. (eds.), pp. 303-316, Academic Press, 1985; and Thorpe et al., 1982, "The Preparation And Cytotoxic Properties Of Antibody-Toxin Conjugates", *Immunol. Rev.,* 62:119-158. Alternatively, an antibody can be conjugated to a second antibody to form an antibody heteroconjugate, e.g., as described in U.S. Pat. No. 4,676,980 to Segal, which is incorporated herein by reference in its entirety. An antibody, i.e., an antibody specific for a protein tyrosine kinase biomarker polypeptide of this invention, with or without a therapeutic moiety conjugated to it, and administered alone or in combination with cytotoxic factor(s) and/or cytokine(s), can be used as a therapeutic.

The antibodies of the invention can further be utilized for immunophenotyping of cell lines and biological samples. The translation product of the protein tyrosine kinase biomarker-encoding polynucleotides of the present invention can be useful as cell specific marker(s), or more specifically, as cellular marker(s) that are differentially expressed at various stages of differentiation and/or maturation of particular cell types. Monoclonal antibodies directed against a specific epitope, or combination of epitopes, allow for the screening of cellular populations expressing the marker. Various techniques utilizing monoclonal antibodies can be employed to screen for cellular populations expressing the marker(s), including magnetic separation using antibody-coated magnetic beads, "panning" with antibody(ies) attached to a solid matrix (i.e., tissue culture plate), and flow cytometry (See, e.g., U.S. Pat. No. 5,985,660; Morrison et al., 1999, *Cell,* 96:737-749; and L. J. Wysocki and V. L. Sato, 1978, *Proc. Natl. Acad. Sci. USA,* 75(6):2844-8).

These techniques allow for the screening of particular populations of cells, such as might be found with hematological malignancies (i.e. minimal residual disease (MRD) in acute leukemic patients) and "non-self" cells in transplantations to prevent Graft-versus-Host Disease (GVHD). Alternatively, these techniques allow for the screening of hematopoietic stem and progenitor cells capable of undergoing proliferation and/or differentiation, as might be found in human umbilical cord blood.

Antibodies according to this invention can be assayed for immunospecific binding by any method known in the art. The immunoassays which can be used include, but are not limited to, competitive and non-competitive assay systems using techniques such as BIAcore analysis, FACS (Fluorescence Activated Cell Sorter) analysis, immunofluorescence, immunocytochemistry, Western blots, radioimmunoassays, ELISA (enzyme linked immunosorbent assays), "sandwich" immunoassays, immunoprecipitation assays, precipitin reactions, gel diffusion precipitin reactions, immunodiffusion assays, agglutination assays, complement fixation assays, immunoradiometric assays, fluorescent immunoassays, protein A immunoassays, to name but a few. Such assays are routine and well known and practiced in the art (see, e.g., Ausubel et al, eds, 1994, *Current Protocols in Molecular Biology,* Vol. 1, John Wiley & Sons, Inc., New York, which is incorporated by reference herein in its entirety). Nonlimiting, exemplary immunoassays are described briefly below.

Immunoprecipitation protocols generally comprise lysing a population of cells in a lysis buffer such as RIPA buffer (i.e., 1% NP-40 or Triton X-100, 1% sodium deoxycholate, 0.1% SDS, 0.15 M NaCl, 0.01 M sodium phosphate at pH 7.2, 1% Trasylol) supplemented with protein phosphatase and/or protease inhibitors (e.g., EDTA, PMSF, aprotinin, sodium vanadate); adding the antibody of interest to the cell lysate; incubating for a period of time (e.g., 1 to 4 hours) at 4° C.; adding protein A and/or protein G sepharose beads to the cell lysate; incubating for about 60 minutes or more at 4° C.; washing the beads in lysis buffer; and resuspending the beads in SDS/sample buffer. The ability of the antibody of interest to immunoprecipitate a particular antigen can be assessed by, for example, Western blot analysis. One of skill in the art would be knowledgeable as to the parameters that can be modified to increase the binding of the antibody to an antigen and decrease the background (e.g., pre-clearing the cell lysate with sepharose beads). For further discussion regarding immunoprecipitation protocols, see, e.g., Ausubel et al, eds, 1994, *Current Protocols in Molecular Biology,* Vol. 1, John Wiley & Sons, Inc., New York, at 10.16.1.

Western blot analysis generally comprises preparing protein samples; electrophoresis of the protein samples in a polyacrylamide gel (e.g., 8%-20% SDS PAGE depending on the molecular weight of the antigen); transferring the protein sample from the polyacrylamide gel to a membrane such as nitrocellulose, PVDF or nylon; blocking the membrane in blocking solution (e.g., PBS with 3% BSA or nonfat milk); washing the membrane in washing buffer (e.g., PBS-Tween 20); blocking the membrane with primary antibody (the antibody of interest) diluted in blocking buffer; washing the membrane in washing buffer; blocking the membrane with a secondary antibody (which recognizes the primary antibody, e.g., an anti-human antibody) conjugated to an enzymatic substrate (e.g., horseradish peroxidase or alkaline phosphatase) or radioactive molecule (e.g., $^{32}P$ or $^{125}I$) diluted in blocking buffer; washing the membrane in wash buffer; and detecting the presence of the bound antigen. One of skill in the art would be knowledgeable as to the parameters that can be modified to increase the signal detected and to reduce the background noise. For further discussion regarding Western blot protocols, see, e.g., Ausubel et al, eds, 1994, *Current Protocols in Molecular Biology,* Vol. 1, John Wiley & Sons, Inc., New York, at 10.8.1.

ELISAs comprise preparing antigen; coating the wells of a 96 well microtiter plate with antigen; adding to the wells the antibody of interest conjugated to a detectable compound such as an enzymatic substrate (e.g., horseradish peroxidase or alkaline phosphatase); incubating for a period of time; and detecting the presence of the antigen. In ELISAs, the antibody of interest does not have to be conjugated to a detectable compound; instead, a second antibody (which recognizes the antibody of interest bound to antigen) conjugated to a detectable compound can be added to the wells. Further, instead of coating the wells with antigen, the antibodies can be first coated onto the well. In this case, a second antibody conjugated to a detectable compound can be added to the antibody-coated wells following the addition of the antigen of interest. One of skill in the art would be knowledgeable as to the parameters that can be modified to increase the signal detected, as well as other variations of ELISAs known in the art. For further discussion regarding ELISAs, see, e.g., Ausubel et al, eds, 1994, *Current Protocols in Molecular Biology*, Vol. 1, John Wiley & Sons, Inc., New York, at 11.2.1.

The binding affinity of an antibody to an antigen and the off-rate of an antibody-antigen interaction can be determined by competitive binding assays. One example of a competitive binding assay is a radioimmunoassay involving the incubation of labeled antigen (e.g., $^{3}H$ or $^{125}I$), or a fragment or variant thereof, with the antibody of interest in the presence of increasing amounts of labeled antigen, and the detection of the antibody bound to the labeled antigen. The affinity of the antibody of interest for a protein tyrosine kinase biomarker and the binding off rates can be determined from the data by Scatchard plot analysis. Competition with a second antibody can also be determined using radioimmunoassays. In this case, the tyrosine kinase biomarker protein is incubated with an antibody of interest conjugated to a labeled compound (e.g., a compound labeled with $^{3}H$ or $^{125}I$) in the presence of increasing amounts of an unlabeled second antibody. This kind of competitive assay between two antibodies can also be used to determine if two antibodies bind to the same or different epitopes on an antigen.

In a preferred embodiment, BIAcore kinetic analysis is used to determine the binding on and off rates of antibodies (including antibody fragments or variants thereof) to a tyrosine kinase biomarker protein, or fragments of a tyrosine kinase biomarker protein. Kinetic analysis comprises analyzing the binding and dissociation of antibodies from chips with immobilized tyrosine kinase biomarker protein on the chip surface.

It is to be further understood that the above-described techniques for the production, expression, isolation, and manipulation of antibody molecules, for example, by recombinant techniques involving molecular biology, as well as by other techniques related to the analysis of polynucleotides and proteins, are applicable to other polypeptide or peptide molecules of the invention as described herein, in particular, the tyrosine kinase biomarker polypeptides or peptides themselves, as applicable or warranted. in accordance with the various embodiments of this invention.

The present invention also embraces a kit for determining, predicting, or prognosing drug susceptibility or resistance by a patient having a disease, particularly a cancer or tumor, preferably, a breast cancer or tumor. Such kits are useful in a clinical setting for use in testing patient's biopsied tumor or cancer samples, for example, to determine or predict if the patient's tumor or cancer will be resistant or sensitive to a given treatment or therapy with a drug, compound, chemotherapy agent, or biological treatment agent. Provided in the kit are the predictor set comprising those polynucleotides correlating with resistance and sensitivity to protein tyrosine kinase modulators in a particular biological system, particularly protein tyrosine kinase inhibitors, and preferably comprising a microarray; and, in suitable containers, the modulator compounds for use in testing cells from patient tissue or patient samples for resistance/sensitivity; and instructions for use. Such kits encompass predictor set comprising those polynucleotides correlating with resistance and sensitivity to modulators of protein tyrosine kinases including members of the Src family of tyrosine kinases, for example, Src, Fgr, Fyn, Yes, Blk, Hck, Lck and Lyn, as well as other protein tyrosine kinases, including, Bcr-abl, Jak, PDGFR, c-kit and Eph receptors, Also, as explained above, the kit is not limited to microarrays, but can encompass a variety of methods and systems by which the expression of the predictor/marker polynucleotides can be assayed and/or monitored, both at the level of mRNA and of protein, for example, via PCR assays, e.g., RT-PCR and immunoassay, such as ELISA. In kits for performing PCR, or in situ hybridization, for example, nucleic acid primers or probes from the sequences of one or more of the predictor polynucleotides, such as those described herein, in addition to buffers and reagents as necessary for performing the method, and instructions for use. In kits for performing immunoassays, e.g. ELISAs, immunoblotting assays, and the like, antibodies, or bindable portions thereof, to the protein tyrosine kinase biomarker polypeptides of the invention, or to antigenic or immunogenic peptides thereof, are supplied, in addition to buffers and reagents as necessary for performing the method, and instructions for use. The kits according to the present invention can also comprise predictor polynucleotides as set forth in Table 2, and/or one or more of the specific predictor polynucleotide subsets as presented in Tables 4-5 herein.

In another embodiment, the present invention embraces the use of one or more polynucleotides among those of the predictor polynucleotides identified herein that can serve as targets for the development of drug therapies for disease treatment. Such targets may be particularly applicable to treatment of breast diseases, such as breast cancers or tumors. Indeed, because these predictor polynucleotides are differently expressed in sensitive and resistant cells, their expression pattern is correlated with relative intrinsic sensitivity of cells to treatment with compounds that interact with and inhibit protein tyrosine kinases. Accordingly, the polynucleotides highly expressed in resistant cells can serve as targets for the development of drug therapies for the tumors which are resistant to protein tyrosine kinase inhibitor compounds, for example, Src tyrosine kinase inhibitors.

In another embodiment, the present invention embraces antisense and/or siRNAi reagents as specific modulators of the predictor polynucleotides of the present invention. In specific embodiments, antagonists according to the present invention are nucleic acids corresponding to the sequences contained in one or more of the sequences provided as SEQ ID NO:1 thru 137, or the complementary strand thereof. In one embodiment, antisense sequence is generated internally by the organism, in another embodiment, the antisense sequence is separately administered (see, for example, O'Connor, Neurochem., 56:560 (1991). Oligodeoxynucleotides as Antisense Inhibitors of Gene Expression, CRC Press, Boca Raton, Fla. (1988). Antisense technology can be used to control gene expression through antisense DNA or RNA, or through triple-helix formation. Antisense techniques are discussed for example, in Okano, Neurochem., 56:560 (1991); Oligodeoxynucleotides as Antisense Inhibitors of Gene Expression, CRC Press, Boca Raton, Fla. (1988). Triple helix formation is discussed in, for instance, Lee et al., Nucleic Acids Research, 6:3073 (1979); Cooney et al., Science, 241:456 (1988); and Dervan et al., Science, 251:1300 (1991). The methods are based on binding of a polynucleotide to a complementary DNA or RNA.

For example, the use of c-myc and c-myb antisense RNA constructs to inhibit the growth of the non-lymphocytic leukemia cell line HL-60 and other cell lines was previously described. (Wickstrom et al. (1988); Anfossi et al. (1989)). These experiments were performed in vitro by incubating cells with the oligoribonucleotide. A similar procedure for in vivo use is described in WO 91/15580. Briefly, a pair of oligonucleotides for a given antisense RNA is produced as follows: A sequence complimentary to the first 15 bases of the open reading frame is flanked by an EcoR1 site on the 5 end and a HindIII site on the 3 end. Next, the pair of oligonucleotides is heated at 90° C. for one minute and then annealed in 2× ligation buffer (20 mM TRIS HCl pH 7.5, 10 mM MgCl2, 10 MM dithiothreitol (DTT) and 0.2 mM ATP) and then ligated to the EcoR1/Hind III site of the retroviral vector PMV7 (WO 91/15580).

For example, the 5' coding portion of a polynucleotide that encodes the mature polypeptide of the present invention may be used to design an antisense RNA oligonucleotide of from about 10 to 40 base pairs in length. A DNA oligonucleotide is designed to be complementary to a region of the gene involved in transcription thereby preventing transcription and the production of the receptor. The antisense RNA oligonucleotide hybridizes to the mRNA in vivo and blocks translation of the mRNA molecule into receptor polypeptide. Antisense oligonucleotides may be single or double stranded. Double stranded RNA's may be designed based upon the teachings of Paddison et al., Proc. Nat. Acad. Sci., 99:1443-1448 (2002); and International Publication Nos. WO 01/29058, and WO 99/32619; which are hereby incorporated herein by reference.

In one embodiment, the antisense nucleic acid of the invention is produced intracellularly by transcription from an exogenous sequence. For example, a vector or a portion thereof, is transcribed, producing an antisense nucleic acid (RNA) of the invention. Such a vector would contain a sequence encoding the antisense nucleic acid of the invention. Such a vector can remain episomal or become chromosomally integrated, as long as it can be transcribed to produce the desired antisense RNA. Such vectors can be constructed by recombinant DNA technology methods standard in the art. Vectors can be plasmid, viral, or others known in the art, used for replication and expression in vertebrate cells. Expression of the sequence encoding a polypeptide of the invention, or fragments thereof, can be by any promoter known in the art to act in vertebrate, preferably human cells. Such promoters can be inducible or constitutive. Such promoters include, but are not limited to, the SV40 early promoter region (Bemoist and Chambon, Nature, 29:304-310 (1981), the promoter contained in the 3' long terminal repeat of Rous sarcoma virus (Yamamoto et al., Cell, 22:787-797 (1980), the herpes thymidine promoter (Wagner et al., Proc. Natl. Acad. Sci. U.S.A., 78:1441-1445 (1981), the regulatory sequences of the metallothionein gene (Brinster et al., Nature, 296:39-42 (1982)), etc.

The antisense nucleic acids of the invention comprise a sequence complementary to at least a portion of an RNA transcript of a gene of interest. However, absolute complementarity, although preferred, is not required. A sequence "complementary to at least a portion of an RNA" referred to herein, means a sequence having sufficient complementarity to be able to hybridize with the RNA, forming a stable duplex; in the case of double stranded antisense nucleic acids of the invention, a single strand of the duplex DNA may thus be tested, or triplex formation may be assayed. The ability to hybridize will depend on both the degree of complementarity and the length of the antisense nucleic acid Generally, the larger the hybridizing nucleic acid, the more base mismatches with a RNA sequence of the invention it may contain and still form a stable duplex (or triplex as the case may be). One skilled in the art can ascertain a tolerable degree of mismatch by use of standard procedures to determine the melting point of the hybridized complex.

Oligonucleotides that are complementary to the 5' end of the message, e.g., the 5' untranslated sequence up to and including the AUG initiation codon, should work most efficiently at inhibiting translation. However, sequences complementary to the 3' untranslated sequences of mRNAs have been shown to be effective at inhibiting translation of mRNAs as well. See generally, Wagner, R., Nature, 372:333-335 (1994). Thus, oligonucleotides complementary to either the 5'- or 3'-non-translated, non-coding regions of a polynucleotide sequence of the invention could be used in an antisense approach to inhibit translation of endogenous mRNA. Oligonucleotides complementary to the 5' untranslated region of the mRNA should include the complement of the AUG start codon. Antisense oligonucleotides complementary to mRNA coding regions are less efficient inhibitors of translation but could be used in accordance with the invention. Whether designed to hybridize to the 5'-, 3'- or coding region of mRNA, antisense nucleic acids should be at least six nucleotides in length, and are preferably oligonucleotides ranging from 6 to about 50 nucleotides in length. In specific aspects the oligonucleotide is at least 10 nucleotides, at least 17 nucleotides, at least 25 nucleotides or at least 50 nucleotides.

The polynucleotides of the invention can be DNA or RNA or chimeric mixtures or derivatives or modified versions thereof, single-stranded or double-stranded. The oligonucleotide can be modified at the base moiety, sugar moiety, or phosphate backbone, for example, to improve stability of the molecule, hybridization, etc. The oligonucleotide may include other appended groups such as peptides (e.g., for targeting host cell receptors in vivo), or agents facilitating transport across the cell membrane (see, e.g., Letsinger et al., Proc. Natl. Acad. Sci. U.S.A. 86:6553-6556 (1989); Lemaitre et al., Proc. Natl. Acad. Sci., 84:648-652 (1987); PCT Publication NO: WO88/09810, published Dec. 15, 1988) or the blood-brain barrier (see, e.g., PCT Publication NO: WO89/10134, published Apr. 25, 1988), hybridization-triggered cleavage agents. (See, e.g., Krol et al., BioTechniques, 6:958-976 (1988)) or intercalating agents. (See, e.g., Zon, Pharm. Res., 5:539-549 (1988)). To this end, the oligonucleotide may be conjugated to another molecule, e.g., a peptide, hybridization triggered cross-linking agent, transport agent, hybridization-triggered cleavage agent, etc.

Double stranded RNA's may be designed based upon the teachings of Paddison et al., Proc. Nat. Acad. Sci., 99:1443-1448 (2002); and International Publication Nos. WO 01/29058, and WO 99/32619; which are hereby incorporated herein by reference.

SiRNA reagents are specifically contemplated by the present invention. Such reagents are useful for inhibiting expression of the polynucleotides of the present invention and may have therapeutic efficacy. Several methods are known in the art for the therapeutic treatment of disorders by the administration of siRNA reagents. One such method is described by Tiscornia et al (PNAS, 100(4):1844-1848 (2003)), which is incorporated by reference herein in its entirety.

The antisense oligonucleotide may comprise at least one modified base moiety which is selected from the group including, but not limited to, 5-fluorouracil, 5-bromouracil, 5-chlorouracil, 5-iodouracil, hypoxanthine, xanthine, 4-acetylcytosine, 5-(carboxyhydroxylmethyl) uracil, 5-carboxymethylaminomethyl-2-thiouridine, 5-carboxymethylaminomethyluracil, dihydrouracil, beta-D-galactosylqueosine, inosine, N6-isopentenyladenine, 1-methylguanine, 1-methylinosine, 2,2-dimethylguanine, 2-methyladenine, 2-methylguanine, 3-methylcytosine, 5-methylcytosine, N6-adenine, 7-methylguanine, 5-methylaminomethyluracil, 5-methoxyaminomethyl-2-thiouracil, beta-D-mannosylqueosine, 5'-methoxycarboxymethyluracil, 5-methoxyuracil, 2-methylthio-N6-isopentenyladenine, uracil-5-oxyacetic acid (v), wybutoxosine, pseudouracil, queosine, 2-thiocytosine, 5-methyl-2-thiouracil, 2-thiouracil, 4-thiouracil, 5-methyluracil, uracil-5-oxyacetic acid methylester, uracil-5-oxyacetic acid (v), 5-methyl-2-thiouracil, 3-(3-amino-3-N-2-carboxypropyl) uracil, (acp3)w, and 2,6-diaminopurine.

The antisense oligonucleotide may also comprise at least one modified sugar moiety selected from the group including, but not limited to, arabinose, 2-fluoroarabinose, xylulose, and hexose.

In yet another embodiment, the antisense oligonucleotide comprises at least one modified phosphate backbone selected from the group including, but not limited to, a phosphorothioate, a phosphorodithioate, a phosphoramidothioate, a phosphoramidate, a phosphordiamidate, a methylphosphonate, an alkyl phosphotriester, and a formacetal or analog thereof.

In yet another embodiment, the antisense oligonucleotide is an a-anomeric oligonucleotide. An a-anomeric oligonucleotide forms specific double-stranded hybrids with complementary RNA in which, contrary to the usual b-units, the strands run parallel to each other (Gautier et al., Nucl. Acids Res., 15:6625-6641 (1987)). The oligonucleotide is a 2-0-methylribonucleotide (Inoue et al., Nucl. Acids Res., 15:6131-6148 (1987)), or a chimeric RNA-DNA analogue (Inoue et al., FEBS Lett. 215:327-330 (1987)).

Polynucleotides of the invention may be synthesized by standard methods known in the art, e.g. by use of an automated DNA synthesizer (such as are commercially available from Biosearch, Applied Biosystems, etc.). As examples, phosphorothioate oligonucleotides may be synthesized by the method of Stein et al. (Nucl. Acids Res., 16:3209 (1988)), methylphosphonate oligonucleotides can be prepared by use of controlled pore glass polymer supports (Sarin et al., Proc. Natl. Acad. Sci. U.S.A., 85:7448-7451 (1988)), etc.

While antisense nucleotides complementary to the coding region sequence of the invention could be used, those complementary to the transcribed untranslated region are most preferred.

Potential antagonists according to the invention also include catalytic RNA, or a ribozyme (See, e.g., PCT International Publication WO 90/11364, published Oct. 4, 1990; Sarver et al, Science, 247:1222-1225 (1990). While ribozymes that cleave mRNA at site specific recognition sequences can be used to destroy mRNAs corresponding to the polynucleotides of the invention, the use of hammerhead ribozymes is preferred. Hammerhead ribozymes cleave mRNAs at locations dictated by flanking regions that form complementary base pairs with the target mRNA. The sole requirement is that the target mRNA have the following sequence of two bases: 5'-UG-3'. The construction and production of hammerhead ribozymes is well known in the art and is described more fully in Haseloff and Gerlach, Nature, 334:585-591 (1988). There are numerous potential hammerhead ribozyme cleavage sites within each nucleotide sequence disclosed in the sequence listing. Preferably, the ribozyme is engineered so that the cleavage recognition site is located near the 5' end of the mRNA corresponding to the polynucleotides of the invention; i.e., to increase efficiency and minimize the intracellular accumulation of non-functional mRNA transcripts.

As in the antisense approach, the ribozymes of the invention can be composed of modified oligonucleotides (e.g. for improved stability, targeting, etc.) and should be delivered to cells which express the polynucleotides of the invention in vivo. DNA constructs encoding the ribozyme may be introduced into the cell in the same manner as described above for the introduction of antisense encoding DNA. A preferred method of delivery involves using a DNA construct "encoding" the ribozyme under the control of a strong constitutive promoter, such as, for example, pol III or pol II promoter, so that transfected cells will produce sufficient quantities of the ribozyme to destroy endogenous messages and inhibit translation. Since ribozymes unlike antisense molecules, are catalytic, a lower intracellular concentration is required for efficiency.

Antagonist/agonist compounds may be employed to inhibit the cell growth and proliferation effects of the polypeptides of the present invention on neoplastic cells and tissues, i.e. stimulation of angiogenesis of tumors, and, therefore, retard or prevent abnormal cellular growth and proliferation, for example, in tumor formation or growth.

The antagonist/agonist may also be employed to prevent hyper-vascular diseases, and prevent the proliferation of epithelial lens cells after extracapsular cataract surgery. Prevention of the mitogenic activity of the polypeptides of the present invention may also be desirous in cases such as restenosis after balloon angioplasty.

The antagonist/agonist may also be employed to prevent the growth of scar tissue during wound healing.

The antagonist/agonist may also be employed to treat, prevent, and/or diagnose the diseases described herein.

Thus, the invention provides a method of treating or preventing diseases, disorders, and/or conditions, including but not limited to the diseases, disorders, and/or conditions listed throughout this application, associated with overexpression of a polynucleotide of the present invention by administering to a patient (a) an antisense molecule directed to the polynucleotide of the present invention, and/or (b) a ribozyme directed to the polynucleotide of the present invention.

EXAMPLES

The Examples herein are meant to exemplify the various aspects of carrying out the invention and are not intended to limit the scope of the invention in any way. The Examples do not include detailed descriptions for conventional methods employed, such as in the construction of vectors, the insertion of cDNA into such vectors, or the introduction of the resulting vectors into the appropriate host. Such methods are well known to those skilled in the art and are described in numerous publications, for example, Sambrook, Fritsch, and Maniatis, *Molecular Cloning: A Laboratory Manual*, $2^{nd}$ Edition, Cold Spring Harbor Laboratory Press, USA, (1989).

Example 1

Methods $IC_{50}$ Determination—In Vitro Cytotoxicity Assay

The protein tyrosine kinase inhibitor compound (described in international application WO 00/62778, published Oct. 26, 2000) was tested for cytotoxicity in vitro against a panel of twenty-three human breast cell lines available from the American Type Culture Collection, ATCC, except H3396, which was obtained from Pacific Northwest Research Institute, Seattle Wash. The MCF7/Her2 cell line was established by stable transfection of MCF7 cells with the HER2 gene. Cytotoxicity was assessed in cells by the MTS (3-(4,5-dimethylthiazol-2-yl)-5-(3-carboxy-methoxyphenyl)-2-(4-sulphenyl)-2H-tetrazolium, inner salt) assay (T. L. Riss et al., 1992, *Mol. Biol. Cell*, 3 (Suppl.):184a).

To carry out the assays, the breast cells were plated at 4,000 cells/well in 96 well microtiter plates, and 24 hours later, serially diluted drugs were added. The concentration range for the protein tyrosine kinase inhibitor compound BMS-A used in the cytotoxicity assay was from 5 μg/ml to 0.0016 μg/ml (roughly 10 μM to 0.0032 μM).

The cells were incubated at 37° C. for 72 hours at which time the tetrazolium dye, MTS (333 μg/ml final concentration), in combination with the electron coupling agent phenazine methosulfate (25 μM final concentration), was added. A dehydrogenase enzyme in live cells reduces the MTS to a form that absorbs light and can be quantified spectrophotometrically at 492 nM. The greater the absorbency the greater the number of live cells. The results are expressed as an $IC_{50}$, which is the drug concentration required to inhibit cell proliferation (i.e. absorbance at 492 nM) to 50% of that of untreated control cells. The mean $IC_{50}$ and standard deviation (SD) from multiple tests for each cell line were calculated.

Resistant/Sensitivity Classification

The $IC_{50}$ of the BMS-A protein tyrosine kinase inhibitor compound for each cell line was log-transformed to $\log_{10}(IC_{50})$, and the mean $\log_{10}(IC_{50})$ across the 23 human breast cell lines was calculated. The resistance/sensitivity phenotype of the cell lines was classified as follows: the cell lines with $\log_{10}(IC_{50})$ below the mean $\log_{10}(IC_{50})$ of all 23 cell lines were defined as sensitive to the compound, while those with $\log_{10}(IC_{50})$ above the mean $\log_{10}(IC_{50})$ were considered to be resistant to the compound. The resistance/sensitivity classification is shown in Table 1 and 7 cell lines classified as sensitive and 16 cell lines classified as resistant to the protein tyrosine kinase inhibitor compound BMS-A.

Polynucleotide Expression Profiling

The breast cells were grown under standard cell culture conditions: RPMI 1640 supplemented to contain 10% fetal bovine serum, 100 IU/ml penicillin, 100 mg/ml streptomycin, 2 mM L-glutamine and 10 mM Hepes (all from GibcoBRL, Rockville, Md.). RNA was isolated from the cultured cells, either treated or untreated with drug (i.e., the protein tyrosine kinase inhibitor compound) at 50-70% confluence using the RNeasy™ kits commercially available from Qiagen, Valencia, Calif. The quality of the RNA was assessed by measuring the 28s:18s ribosomal RNA ratio using an Agilent 2100 bioanalyzer (Agilent Technologies, Rockville, Md.). The concentration of total RNA was determined spectrophotometrically. 10 μg of total RNA from each cell line was used to prepare biotinylated probe according to the Affymetrix Genechip® Expression Analysis Technical Manual, 2001. Targets were hybridized to Affymetrix high density oligonucleotide array human HG-U133 set chips (Affymetrix, Santa Clara, Calif.). The arrays were then washed and stained using the GeneChip® Fluidics station according to the manufacture's instructions (Affymetrix Genechip® Technical Manual, 2001). The HG-U133 set contains 2 Genechip® arrays, which contain approximately 45,000 probe sets representing more than 39,000 transcripts derived from approximately 33,000 well-substantiated human polynucleotides.

Preprocessing of Microarray Data

Scanned image files were visually inspected for artifacts and analyzed with GeneChip® Expression Analysis software MAS 5.0 (Affymetrix, Santa Clara, Calif.). The "Detection Call" (Affymetrix Genechip® Expression Analysis Technical Manual, 2001) is used to determine whether a transcript is detected within one sample; the "Signal" (Affymetrix Genechip® Expression Analysis Technical Manual, 2001) measures the relative abundance of a transcript. The trimmed mean intensity for each chip was scaled to 1,500 (see, Affymetrix Genechip® Expression Analysis Technical Manual, 2001) in order to account for any minor differences in global chip intensity, so that the overall expression level for each cell line was comparable. Affymetrix control sequences were removed prior to analysis.

Of a total of 44,792 probe sets on the HG-U133 arrays, 15,707 represented probe sets were not detected (Absent Call; p-value >0.06) across all of the 23 breast cell lines using the Affymetrix GeneChip® Expression Analysis algorithm; these undetected polynucleotides were excluded from further analysis.

The remaining data containing 29,085 probe sets were transferred to the GeneCluster software (Whitehead Institute; T. R. Golub et al., 1999, *Science*, 286:531-537). A threshold filter was applied to the polynucleotide expression values of the remaining data to remove low and high polynucleotide expression values that were not likely to be in the linear range of the Affymetrix fluorescent scanner. The threshold filter converted all polynucleotide expression values that were below 100 units to 100 units, and all polynucleotide expression values that were above 45,000 units to 45,000 units. All represented polynucleotides whose polynucleotide expression values were between 100 and 45,000 were not changed.

A second "variation filter" was then applied to the data set to find polynucleotides that were likely to correlate with different properties and features of the 23 cell lines. The object of the second filter was to select those polynucleotides whose expression pattern varied across the data set, because a polynucleotide that does not vary can not provide information about differing properties of the 23 cell line panel. For example, if there are two populations of cells within the data set, e.g., fast growing cells and slow growing cells, then a polynucleotide whose expression is constant, or whose expression does not change substantially, can not yield information that would correlate to fast or slow cell growth.

The second variation filter was formulated to determine the expression pattern of each polynucleotide across the 23 breast cell lines and to find polynucleotides that passed the following criteria:

1. The polynucleotide must show a three-fold change in absolute expression, i.e., as depicted in the formula:

$$\frac{\text{expression value in any given cell line}}{\text{expression value in any other cell line}} > 3 \text{ or } < 0.33$$

2. In addition to 1, the three-fold change must represent an absolute difference of 1000 expression units.

3. In addition, the criteria in #1 and #2 above must be met on four independent occasions within the data set, i.e., Cell line A/B, Cell line E/F, Cell line C/U and Cell line T/G. (The algorithm does not use a single expression value for one cell line on multiple occasions, i.e., Cell Line A/B, Cell line A/G, Cell line A/F and Cell line B/F).

The second variation filter reduced the data set to 5322 polynucleotides. After the second variation filter, the expression value for each polynucleotide was log transformed and normalized to the mean across all of the 23 samples (mean set to 0 and standard deviation set to 1). This normalized data set was used to select polynucleotides which significantly correlated with the property of sensitivity toward a drug class as described herein.

Drug (BMS-A) Treatment of Breast Cell Lines and Selection of Polynucleotides Modified by the Drug The 11 breast cell lines (indicated in bold in the Table 1) with an $IC_{50}$ ranging from 0.0055 to 9.5 µM were used in a drug induction study employing the BMS-A protein tyrosine kinase inhibitor. Cells were seeded in a 10 cm² culture plate in cell culture medium as described herein and were cultured for 24 hours at 37° C. The medium was then changed to medium containing drug (0.4 µM BMS-A compound in 0.1% DMSO, Sigma); the cells were incubated for another 24 hours, and then lysed for RNA isolation. The expression profiling was performed as described above and data were analyzed using GeneChip® Expression Analysis software MAS 5.0 (Affymetrix, Santa Clara, Calif.). The expression data of a drug treated cell line were compared pair-wise to data from the same cell line untreated with drug. A change in p-value was calculated, indicating an increase, decrease or no change in polynucleotide expression. When the p-value was less than 0.0025, the change was considered to be significant. This analysis was performed for all 11 cell lines to compare the polynucleotide expression with or without drug treatment.

Example 2

PCR Expression Profiling

RNA quantification is performed using the Taqman® real-time-PCR fluorogenic assay. The Taqman® assay is one of the most precise methods for assaying the concentration of nucleic acid templates.

RNA is prepared using standard methods, preferably, employing the RNeasy Maxi Kit commercially available from Qiagen (Valencia, Calif.). A cDNA template for real-time PCR can be generated using the Superscript™ First Strand Synthesis system for RT-PCR. Representative forward and reverse RT-PCT primers for each of the protein tyrosine kinase biomarker polynucleotides of the present invention are provided in Table 6.

SYBR Green real-time PCR reactions are prepared as follows: The reaction mix contains 20 ng first strand cDNA; 50 nM Forward Primer; 50 nM Reverse Primer; 0.75×SYBR Green I (Sigma); 1×SYBR Green PCR Buffer (50 mM Tris-HCl pH 8.3, 75 mM KCl); 10% DMSO; 3 mM $MgCl_2$; 300 µM each dATP, dGTP, dTTP, dCTP; 1 U Platinum® Taq DNA Polymerase High Fidelity (Cat# 11304-029; Life Technologies; Rockville, Md.). Real-time PCR is performed using an Applied Biosystems 5700 Sequence Detection System. Conditions are 95° C. for 10 minutes (denaturation and activation of Platinum® Taq DNA Polymerase), 40 cycles of PCR (95° C. for 15 seconds, 60° C. for 1 minute). PCR products are analyzed for uniform melting using an analysis algorithm built into the 5700 Sequence Detection System.

cDNA quantification used in the normalization of template quantity is performed using Taqman® technology. Taqman® reactions are prepared as follows: The reaction mix comprises 20 ng first strand cDNA; 25 nM GAPDH-F3, Forward Primer; 250 nM GAPDH-R1 Reverse Primer; 200 nM GAPDH-PVIC Taqman® Probe (fluorescent dye labeled oligonucleotide primer); 1× Buffer A (Applied Biosystems); 5.5 mM $MgCl_2$; 300 µM dATP, dGTP, dTTP, dCTP; and 1 U Amplitaq Gold (Applied Biosystems). GAPDH (D-glyceraldehyde-3-phosphate dehydrogenase) is used as a control to normalize mRNA levels. Real-time Taqman® PCR is performed using an Applied Biosystems 7700 Sequence Detection System. Conditions are 95° C. for 10 minutes (denaturation and activation of Amplitaq Gold), 40 cycles of PCR (95° C. for 15 seconds, 60° C. for 1 minute).

The sequences for the GAPDH oligonucleotides used in the Taqman®reactions are as follows:

```
                                            (SEQ ID NO:531)
GAPDH-    5'-AGCCGAGCCACATCGCT-3';
F3:

(SEQ ID NO:532)
GAPDH-    5'-GTGACCAGGCGCCCAATAC-3';  and
R1:

(SEQ ID NO:533)
GAPDH-    5'-CAAATCCGTTGACTCCGACCTTCACCTT-3' TAMRA.
PVIC Taqman ® Probe-VIC-
```

The Sequence Detection System generates a Ct (threshold cycle) value that is used to calculate a concentration for each input cDNA template. cDNA levels for each polynucleotide of interest are normalized to GAPDH cDNA levels to compensate for variations in total cDNA quantity in the input sample. This is done by generating GAPDH Ct values for each cell line. Ct values for the polynucleotide of interest and GAPDH are inserted into a modified version of the δδCt equation (Applied Biosystems Prism® 7700 Sequence Detection System User Bulletin #2), which is used to calculate a GAPDH normalized relative cDNA level for each specific cDNA. The δδCt equation is as follows: relative quantity of nucleic acid template=$2^{\delta\delta Ct}=2^{(\delta Cta-\delta Ctb)}$, where δCta=Ct target–Ct GAPDH, and δCtb=Ct reference–Ct GAPDH. (No reference cell line is used for the calculation of relative quantity; δCtb is defined as 21).

Example 3

Production of an Antibody Directed Against Protein Tyrosine Kinase Biomarker Polypeptides Anti-protein tyrosine kinase biomarker polypeptide antibodies of the present invention can be prepared by a variety of methods as detailed hereinabove. As one example of an antibody-production method, cells expressing a polypeptide of the present invention are administered to an animal as immunogen to induce the production of sera containing polyclonal antibodies directed against the expressed polypeptide. In a preferred method, the expressed polypeptide is prepared, preferably isolated and/or purified, to render it substantially free of natural contaminants using techniques commonly practiced in the art. Such a preparation is then introduced into an animal in order to produce polyclonal antisera of greater specific activity for the expressed and isolated polypeptide.

In a most preferred method, the antibodies of the present invention are monoclonal antibodies (or protein binding fragments thereof) and can be prepared using hybridoma technology as detailed hereinabove. Cells expressing the polypeptide can be cultured in any suitable tissue culture medium; however, it is frequently preferable to culture cells in Earle's modified Eagle's medium supplemented to contain 10% fetal bovine serum (inactivated at about 56° C.), and supplemented to contain about 10 g/l nonessential amino acids, about 1.0 U/ml penicillin, and about 100 µg/ml streptomycin.

The splenocytes of immunized (and boosted) mice are extracted and fused with a suitable myeloma cell line. Any suitable myeloma cell line can be employed in accordance with the present invention; however, it is preferable to employ the parent myeloma cell line SP2/0, available from the ATCC. After fusion, the resulting hybridoma cells are selectively maintained in HAT medium, and then cloned by limiting dilution as described, for example, by Wands et al. (1981, *Gastroenterology*, 80:225-232). The hybridoma cells obtained through such a selection process are then assayed to identify those cell clones that secrete antibodies capable of binding to the polypeptide immunogen, or a portion thereof.

Alternatively, additional antibodies capable of binding to the polypeptide can be produced in a two-step procedure using anti-idiotypic antibodies. Such a method makes use of the fact that antibodies are themselves antigens, and therefore, it is possible to obtain a second antibody that binds to a first antibody. In accordance with this method, protein-specific antibodies are used to immunize an animal, preferably a mouse. The splenocytes of such an immunized animal are then used to produce hybridoma cells, and the hybridoma cells are screened to identify clones that produce an antibody whose ability to bind to the protein-specific antibodies can be blocked by the protein. Such antibodies comprise anti-idiotypic antibodies to the protein-specific antibody and can be used to immunize an animal to induce the formation of further protein-specific antibodies.

For in vivo use of antibodies in humans, it may be preferable to use "humanized" chimeric monoclonal antibodies. Such antibodies can be produced using genetic constructs derived from hybridoma cells producing the monoclonal antibodies described above. Methods for producing chimeric antibodies are known and practiced in the art. (See, e.g., for review, Morrison, 1985, *Science*, 229:1202); Oi et al., 1986, *BioTechniques*, 4:214; Cabilly et al., U.S. Pat. No. 4,816,567; Taniguchi et al., EP 171496; Morrison et al., EP 173494; Neuberger et al., WO 8601533; Robinson et al., WO 8702671; Boulianne et al., 1984, *Nature*, 312:643; and Neuberger et al., 1985, *Nature*, 314:268).

Example 4

Immunofluorescence Assays

The following immunofluorescence protocol can be used, for example, to verify protein tyrosine kinase biomarker expression in cells, or, for example, to check for the presence of one or more antibodies that bind protein tyrosine kinase biomarkers (polypeptides or peptides) expressed on the surfaces of cells. Briefly, Lab-Tek II chamber slides are coated overnight at 4° C. with 10 µg/ml of bovine collagen Type II in DPBS containing calcium and magnesium (DPBS++). The slides are then washed twice with cold DPBS++ and seeded with approximately 8000 CHO cells transfected with a vector comprising the coding sequence for a protein tyrosine kinase biomarker of the present invention or with CHO cells transfected with vector alone (control) in a total volume of 125 µl and incubated at 37° C. in the presence of 95% oxygen/5% carbon dioxide.

Thereafter, the culture medium is gently removed by aspiration and the adherent cells are washed twice with DPBS++ at ambient temperature. The slides are blocked with DPBS++ containing 0.2% BSA (blocker) at 0-4° C. for one hour. The blocking solution is gently removed by aspiration, and 125 µl of antibody containing solution (an antibody containing solution may be, for example, a hybridoma culture supernatant which is usually used undiluted, or serum/plasma which is usually diluted, e.g., a dilution of about 1:50, 1:100, 1:1000, and the like). The slides are incubated for 1 hour at 0-4° C. Antibody solutions are then gently removed by aspiration and the cells are washed 5 times with 400 µl of ice cold blocking solution. Next, 125 µl of 1 µg/ml rhodamine labeled secondary antibody (e.g., anti-human IgG) in blocker solution is added to the cells. Again, cells are incubated for 1 hour at 0-4° C.

The secondary antibody solution is then gently removed by aspiration and the cells are washed 3 times with 400 µl of ice cold blocking solution, and 5 times with cold DPBS++. The cells are then fixed with 125 µl of 3.7% formaldehyde in DPBS++ for 15 minutes at ambient temperature. Thereafter, the cells are washed 5 times with 400 µl of DPBS++ at ambient temperature. Finally, the cells are mounted in 50% aqueous glycerol and viewed using a fluorescence microscope using rhodamine filters.

Example 5

Complimentary Sequences

Antisense molecules or nucleic acid sequences complementary to the protein tyrosine kinase biomarker polypeptides-encoding sequence, or any part thereof, is used to decrease or to inhibit the expression of naturally occurring protein tyrosine kinase biomarker polypeptides. Although the use of antisense or complementary oligonucleotides comprising about 15 to 35 base-pairs is described, essentially the same procedure is used with smaller or larger nucleic acid sequence fragments. An oligonucleotide based on the coding sequence of protein tyrosine kinase biomarker polypeptides, as depicted in SEQ ID NO:1 thru 137, for example, is used to inhibit expression of naturally occurring protein tyrosine kinase biomarker polypeptides. The complementary oligonucleotide is typically designed from the most unique 5' sequence and is used either to inhibit transcription by preventing promoter binding to the coding sequence, or to inhibit translation by preventing the ribosome from binding to the protein tyrosine kinase biomarker polypeptides-encoding transcript, among others. However, other regions may also be targeted.

Using an appropriate portion of the signal and 5' sequence of SEQ ID NO:1 thru 137, an effective antisense oligonucleotide includes any of about 15-35 nucleotides spanning the region which translates into the signal or 5' coding sequence, among other regions, of the polypeptide as depicted in SEQ ID NO:138 thru 256. Appropriate oligonucleotides may be designed using OLIGO 4.06 software and the protein tyrosine kinase biomarker polypeptides coding sequence (SEQ ID NO:1 thru 137). Preferred oligonucleotides are deoxynucleotide, or chimeric deoxynucleotide/ribonucleotide based and are provided below. The oligonucleotides may be synthesized using chemistry essentially as described in U.S. Pat. No. 5,849,902; which is hereby incorporated herein by reference in its entirety.

Representative RNAi reagent sequences are as follows:

| Target Name | Sense Strand RNAi Reagent | SEQ ID NO: | Anti-Sense Strand RNAi Reagent | SEQ ID NO: |
|---|---|---|---|---|
| caveolin 1-1 | CAGGGCAACAUCUACAAGCTT | 534 | GCUUGUAGAUGUUGCCCUGTT | 546 |
| caveolin 1-2 | GCAAGUGUACGACGCGCACTT | 535 | GUGCGCGUCGUACACUUGCTT | 547 |
| caveolin 1-3 | CCGCUUGCUGUCUGCCCUCTT | 536 | GAGGGCAGACAGCAAGCGGTT | 548 |
| caveolin 1-4 | CAUCUGGGCAGUUGUACCATT | 537 | UGGUACAACUGCCCAGAUGTT | 549 |
| caveolin 2-1 | CUACGCACUCCUUUGACAATT | 538 | UUGUCAAAGGAGUGCGUAGTT | 550 |
| caveolin 2-2 | AGUGUGGAUCUGCAGCCAUTT | 539 | AUGGCUGCAGAUCCACACUTT | 551 |
| caveolin 2-3 | GUUCCUGACGGUGUUCCUGTT | 540 | CAGGAACACCGUCAGGAACTT | 552 |
| caveolin 2-4 | UUGCGGGAAUUCUCUUUGCTT | 541 | GCAAAGAGAAUUCCCGCAATT | 553 |
| ephA2-1 | GGAAGUGGUACUGCUGGACTT | 542 | GUCCAGCAGUACCACUUCCTT | 554 |
| ephA2-2 | CUUCCAGAAGCGCCUGUUCTT | 543 | GAACAGGCGCUUCUGGAAGTT | 555 |
| ephA2-3 | GAGCCCCGUAUGCACUGUGTT | 544 | CACAGUGCAUACGGGGCUCTT | 556 |
| ephA2-4 | CUACACCUUCACCGUGGAGTT | 545 | CUCCACGGUGAAGGUGUAGTT | 557 |

Transfection of Post-Quiescent A549 Cells with AntiSense Oligonucleotides.

Materials needed:
A549 cells can be maintained in DMEM with high glucose (Gibco-BRL) supplemented with 10% Fetal Bovine Serum, 2 mM L-Glutamine, and 1× penicillin/streptomycin.
Opti-MEM (Gibco-BRL)
Lipofectamine 2000 (Invitrogen)
Antisense oligomers (Qiagen)
Polystyrene tubes.
Tissue culture treated plates.

Quiescent cells are prepared as follows:
Day 0: 300,000 A549 cells are seeded in a T75 tissue culture flask in 10 ml of A549 media (as specified above), and incubated in at 37° C., 5% $CO_2$ in a humidified incubator for 48 hours.
Day 2: The T75 flasks are rocked to remove any loosely adherent cells, and the A549 growth media removed and replenished with 10 ml of fresh A549 media. The cells are cultured for six days without changing the media to create a quiescent cell population.
Day 8: Quiescent cells are plated in multi-well format and transfected with antisense oligonucleotides.

A549 cells are transfected according to the following:
1. Trypsinize T75 flask containing quiescent population of A549 cells.
2. Count the cells and seed 24-well plates with 60K quiescent A549 cells per well.
3. Allow the cells to adhere to the tissue culture plate (approximately 4 hours).
4. Transfect the cells with antisense and control oligonucleotides according to the following:
   a. A 10× stock of lipofectamine 2000 (10 ug/ml is 10×) may be prepared, and diluted lipid is allowed to stand at RT for 15 minutes.
   Stock solution of lipofectamine 2000 is 1 mg/ml.
   10× solution for transfection is 10 ug/ml.
   To prepare 10× solution, dilute 10 ul of lipofectamine 2000 stock per 1 ml of Opti-MEM (serum free media).
   b. A 10× stock of each oligomer may be prepared for use in the transfection.
   Stock solutions of oligomers are at 100 uM in 20 mM HEPES, pH 7.5.
   10× concentration of oligomer may be 0.25 uM.
   To prepare the 10× solutions, dilute 2.5 ul of oligomer per 1 ml of Opti-MEM.
   c. Equal volumes of the 10× lipofectamine 2000 stock and the 10× oligomer solutions are mixed well, and incubated for 15 minutes at RT to allow complexation of the oligomer and lipid. The resulting mixture is 5×.
   d. After the 15 minute complexation, 4 volumes of full growth media is added to the oligomer/lipid complexes (solution may be 1×).

e. The media may be aspirated from the cells, and 0.5 ml of the 1× oligomer/lipid complexes added to each well.
f. The cells are incubated for 16-24 hours at 37° C. in a humidified $CO_2$ incubator.
g. Cell pellets are harvested for RNA isolation and TaqMan analysis of the expression of the protein tyrosine kinase biomarker polypeptides to assess level of knock-down.

TaqMan Reactions

Quantitative RT-PCR analysis may be performed on total RNA preps that are treated with DNaseI or poly A selected RNA. The Dnase treatment may be performed using methods known in the art, though preferably using a Qiagen RNeasy kit to purify the RNA samples, wherein DNAse I treatment is performed on the column.

Briefly, a master mix of reagents may be prepared according to the following table:

| Dnase I Treatment | |
|---|---|
| Reagent | Per r'xn (in uL) |
| 10× Buffer | 2.5 |
| Dnase I (1 unit/ul @ 1 unit per ug sample) | 2 |
| DEPC $H_2O$ | 0.5 |
| RNA sample @ 0.1 ug/ul (2-3 ug total) | 20 |
| Total | 25 |

Next, 5 ul of master mix may be aliquoted per well of a 96-well PCR reaction plate (PE part # N801-0560). RNA samples are adjusted to 0.1 ug/ul with DEPC treated $H_2O$ (if necessary), and 20 ul may be added to the aliquoted master mix for a final reaction volume of 25 ul.

The wells are capped using strip well caps (PE part # N801-0935), placed in a plate, and briefly spun in a plate centrifuge (Beckman) to collect all volume in the bottom of the tubes. Generally, a short spin up to 500 rpm in a Sorvall RT is sufficient The plates are incubated at 37° C. for 30 mins. Then, an equal volume of 0.1 mM EDTA in 10 mM Tris may be added to each well, and heat inactivated at 70° C. for 5 min. The plates are stored at −80° C. upon completion.

RT Reaction

A master mix of reagents may be prepared according to the following table:

| | RT Reaction | |
|---|---|---|
| Reagent | RT Per Rx'n (in ul) | No RT er Rx'n (in ul) |
| 10× RT buffer | 5 | 2.5 |
| $MgCl_2$ | 11 | 5.5 |
| DNTP mixture | 10 | 5 |
| Random Hexamers | 2.5 | 1.25 |
| Rnase inhibitors | 1.25 | 0.625 |
| RT enzyme | 1.25 | — |
| Total RNA 500 ng (100 ng no RT) | 19.0 max | 10.125 max |
| DEPC $H_2O$ | — | — |
| Total | 50 uL | 25 uL |

Samples are adjusted to a concentration so that 500 ng of RNA is added to each RT rx'n (100 ng for the no RT). A maximum of 19 ul can be added to the RT rx'n mixture (10.125 ul for the no RT.) Any remaining volume up to the maximum values may be filled with DEPC treated $H_2O$, so that the total reaction volume is 50 ul (RT) or 25 ul (no RT).

On a 96-well PCR reaction plate (PE part # N801-0560), 37.5 ul of master mix may be aliquoted (22.5 ul of no RT master mix), and the RNA sample added for a total reaction volume of 50 ul (25 ul, no RT). Control samples are loaded into two or even three different wells in order to have enough template for generation of a standard curve.

The wells are capped using strip well caps (PE part # N801-0935), placed in a plate, and spin briefly in a plate centrifuge (Beckman) to collect all volume in the bottom of the tubes. Generally, a short spin up to 500 rpm in a Sorvall RT is sufficient.

For the RT-PCR reaction, the following thermal profile may be used:
25° C. for 10 min
48° C. for 30 min
95° C. for 5 min
4° C. hold (for 1 hour)
Store plate @−20° C. or lower upon completion.

TaqMan reaction (Template comes from RT plate.)

A master mix may be prepared according to the following table:

| TaqMan reaction (per well) | |
|---|---|
| Reagent | Per Rx'n (in ul) |
| TaqMan Master Mix | 4.17 |
| 100 uM Probe | .025 |
| 100 uM Forward primer | .05 |
| 100 uM Reverse primer | .05 |
| Template | — |
| DEPC $H_2O$ | 18.21 |
| Total | 22.5 |

Appropriate forward, reverse, and probe primers may be designed for each protein tyrosine kinase biomarker polypeptides coding region for use in the RT-PCR reaction Using a Gilson P-10 repeat pipetter, 22.5 ul of master mix is aliqouted per well of a 96-well optical plate. Then, using P-10 pipetter, 2.5 ul of sample is added to individual wells. Generally, RT samples are run in triplicate with each primer/probe set used, and no RT samples are run once and only with one primer/probe set, often gapdh (or other internal control).

A standard curve is then constructed and loaded onto the plate. The curve has five points plus one no template control (NTC, =DEPC treated $H_2O$). The curve may be made with a high point of 50 ng of sample (twice the amount of RNA in unknowns), and successive samples of 25, 10, 5, and 1 ng. The curve may be made from a control sample(s) (see above).

The wells are capped using optical strip well caps (PE part # N801-0935), placed in a plate, and spun in a centrifuge to collect all volume in the bottom of the tubes. Generally, a short spin up to 500 rpm in a Sorvall RT is sufficient.

Plates are loaded onto a PE 5700 sequence detector making sure the plate is aligned properly with the notch in the upper right hand corner. The lid may be tightened down and run using the 5700 and 5700 quantitation program and the SYBR probe using the following thermal profile:

50° C. for 2 min
95° C. for 10 min
and the following for 40 cycles:
95° C. for 15 sec
60° C. for 1 min
Change the reaction volume to 25 ul.

Once the reaction may be complete, a manual threshold of around 0.1 may be set to minimize the background signal. Additional information relative to operation of the GeneAmp 5700 machine may be found in reference to the following manuals: "GeneAmp 5700 Sequence Detection System Operator Training CD"; and the "User's Manual for 5700 Sequence Detection System"; available from Perkin-Elmer and hereby incorporated by reference herein in their entirety.

The skilled artisan would acknowledge that modifications to the above protocol may be required for each protein tyrosine kinase biomarker polypeptide of the present invention. The skilled artisan would also acknowledge that cell lines other than A549 could be used and that A549 are only provided as an example. The skilled artisan would also acknowledge that other means may be used to assess the ability of a complimentary oligonucleotide, such as the RNAi reagents provided in SEQ ID NO:534 to 557, which include, but are not limited to western blots and ELISA assays, among others.

Example 6

Alternative Method of Assessing Ability of Complimentary Sequences to Modulate Expression Levels of the Protein Tyrosine Kinase Biomarker Polypeptides of the Present Invention Preferred complimentary sequences that may be assessed for their ability to modulate the expression levels the protein tyrosine kinase biomarker polypeptides of the present invention are provided as SEQ ID NO:534 to 557. Other complimentary sequences may be designed based upon the coding region of the protein tyrosine kinase biomarker polypeptides of the present invention as provided as SEQ ID NO:1 thru 137, and are specifically contemplated by the present invention.

Co-Transfection RNAi

Transfection:

Day prior to transfection, seed $2 \times 10^5$ HeLa cells per well of a 24 well dish. The following day, cells should be 90-95% confluent. Dilute 4.5 uL of 20 uM stock RNAi (one or more of SEQ ID NO:534 to 557) in 50 uL Optimem in a polystyrene tube for each RNAi to be transfected (tube A). Mix by gentle tapping. In another polystyrene tube combine 2 uL Lipofectamine 2000 with 50 uL Optimem (tube B). Mix by gentle tapping. Allow to sit at RT for 5'. Combine 50 uL tube B with the 50 uL for each tube A. Mix by gentle tapping. Allow to sit at RT for 15'. Add 500 uL serum/antibiotic-free MEM to each tube to give a final RNAi concentration of 150 nM. (For cotransfections of RNAi with plasmid, use 1 uL of 20 uM stock RNAi (final concentration of 33 nM) along with 1ug vector DNA in tube A, and then proceed with transfection protocol above). Remove the media from HeLa plates and replace with the 600 uL transfection mix. Put in 37° C. 5% CO2 incubator for 4-5 hours. Replace the media with MEM containing 10% FBS.

Controls to include in the transfection include a fluorescent oligonucleotide control (1 U/uL=20 uM) to calculate transfection efficiency, GFP B as a non-specific negative control, CDC2 as a normalizing knockdown control, and an untransfected control receiving no DNA.

Lysis:

48 hours post-transfection, aspirate media and wash cells 1× with approx. 500 uL cold 1×PBS per well. Aspirate and replace with 100 uL cold RIPA containing protease inhibitors (1 mini BM protease inhibitor tablet/10 mL 1×RIPA). Rock and tap the plate a few times and place at 4° C. for 10-15 minutes. Tap/rock the plate several more times. Using a 200 uL pipetteman, aspirate 5-10 times and wash the well to ensure complete lysis and transfer of all material. Transfer lysate to an eppendorf tube and pipette up and down 5-10 times. If sample is still viscous, pipette up and down several more times. Spin samples down for 10' at 14000 RPM 4° C. Samples can now be stored at −20° C. or prepared for loading.

Western Blotting/Novex:

Prepare sample by combining 20 uL lysate with 3 uL reducing reagent and 7 uL 4× gel loading dye. Heat at 70° C. for 10' and then place samples on ice. While samples are heating, prepare desired gel (usually a 4-12% Bis-Tris gel) by removing comb and sealing tape. Place gels in gel box and fill inner and outer chambers with desired buffer (either 1×MES or MOPS—Add 50 mL 20× buffer to 950 mL dH20 for each gel box). Add 600 uL Oxidizing reagent to the inner chamber. Wash out each well by blasting with 500 uL buffer. In well one, load 5 uL marker—Invitrogen's SeeBlue Plus2. Load samples in subsequent lanes. Run gel at 200V for 45-50 minutes. Make up 1× transfer buffer—50 mL 20× transfer buffer, Methanol (100 mL if transferring one gel, 200 mL if transferring 2 gels in the same apparatus) and dH20 to 1000 mL. Soak blotting pads in dH20 and then transfer buffer-make sure to push down on pads to rid of air bubbles. Soak precut Hybond-ECL membrane (Amersham nitrocellulose) in dH20 and then in transfer buffer. Cut the end off of Biorad filter paper to match size of transfer membrane. If transferring one gel, place 2 blotting pads into blotting chamber. For 2 gels, place down 1 pad. Briefly soak a filter paper in transfer buffer and carefully lay on blotting pad. Open gel cassette with cracking tool, cut off top, bottom and sides of gel. Briefly rinse it in transfer buffer and then lay it on filter paper carefully making sure no air bubbles are present. Lay transfer membrane on top again being careful there are no bubbles. Put down filter paper. Put down 2 blotting pads if transferring one gel to complete the sandwich. If transferring 2, put down 1 blotting pad, filter paper, gel, membrane, filter paper, blotting pad. Gels are now ready for transfer. Squeeze together the gel sandwich and place in transfer apparatus. Fill inner and outer chambers with transfer buffers. Transfer gels for 1 hour at 30V.

Remove membranes and place them in Superblock (Pierce) and rock at RT for a minimum of 1 hour-overnight. (I have stored membranes in Superblock at 4° C. over the weekend). Primary antibody and normalizing antibody are diluted in a 1:10 mix of Superblock:1×PBS/0.3% Tween-20. Membranes are incubated and rocked at RT in primary antibody for a minimum of 1 hour-overnight. Membranes are then washed thoroughly in 1×PBS/0.3% Tween-20. I usually give several quick rinses and then rinse 3×5' in 1×PBS/0.3% Tween-20. During the final wash, HRP-conjugated secondary antibody is diluted in 1×PBS/0.3% Tween-20. Add this to membrane and rock at RT for a minimum of 30'. Wash membranes thoroughly. I usually give several quick rinses and then rinse 3×5' in 1×PBS/0.3% Tween-20. Membranes are removed from wash buffer and the excess buffer drained by holding the edge of the membranes on a paper towel. Membranes are placed on Saran Wrap that has been smoothed on benchtop to remove air bubbles. Enough ECL reagent is added to cover the membrane for 1 minute. Remove membranes and drain off excess ECL on paper towel. Place membranes in between two transparency sheets, being careful to smooth out air bubbles.

Quantitation:

Expose membranes using Fluor S-Max. Relative percent inhibition may be determined by comparing the intensity of each band with RNAi treatment to the intensity of each band without RNAi treatment (control). Normalize lanes by dividing band of interest by normalizing band for each lane. Divide the normalized value for each treated sample by the normalized value of the control. Percent inhibition can then be calculated by using the formula (1-above value)×100.

The skilled artisan would acknowledge that modifications to the above protocol may be required for each protein tyrosine kinase biomarker polypeptide of the present invention. 2, put down 1 blotting pad, filter paper, gel, membrane, filter paper, blotting pad. Gels are now ready for transfer. Squeeze together the gel sandwich and place in transfer apparatus. Fill inner and outer chambers with transfer buffers. Transfer gels for 1 hour at 30V.

Remove membranes and place them in Superblock (Pierce) and rock at RT for a minimum of 1 hour-overnight. (I have stored membranes in Superblock at 4° C. over the weekend). Primary antibody and normalizing antibody are diluted in a 1:10 mix of Superblock: 1×PBS/0.3% Tween-20. Membranes are incubated and rocked at RT in primary antibody for a minimum of 1 hour-overnight. Membranes are then washed thoroughly in 1×PBS/0.3% Tween-20. I usually give several quick rinses and then rinse 3×5' in 1×PBS/0.3% Tween-20. During the final wash, HRP-conjugated secondary antibody is diluted in 1×PBS/0.3% Tween-20. Add this to membrane and rock at RT for a minimum of 30'. Wash membranes thoroughly. I usually give several quick rinses and then rinse 3×5' in 1×PBS/0.3% Tween-20. Membranes are removed from wash buffer and the excess buffer drained by holding the edge of the membranes on a paper towel. Membranes are placed on Saran Wrap that has been smoothed on benchtop to remove air bubbles. Enough ECL reagent is added to cover the membrane for 1 minute. Remove membranes and drain off excess ECL on paper towel. Place membranes in between two transparency sheets, being careful to smooth out air bubbles.

Quantitation:

Expose membranes using FluorS-Max. Relative percent inhibition may be determined by comparing the intensity of each band with RNAi treatment to the intensity of each band without RNAi treatment (control). Normalize lanes by dividing band of interest by normalizing band for each lane. Divide the normalized value for each treated sample by the normalized value of the control. Percent inhibition can then be calculated by using the formula (1-above value)×100.

The skilled artisan would acknowledge that modifications to the above protocol may be required for each protein tyrosine kinase biomarker polypeptide of the present invention.

SEQUENCE LISTING (557 sequences)

SEQ ID NO: 1 - DNA, 3921 bp, Homo sapiens
cggaagttgcgcgcaggccggcgggcgggagcggacaccgaggccggcgtgcaggcgtgcgggtgtgcgggagccgggctcggggggatcggaccgagagcgagaagcgcggcatggagctccaggcagcccgcgcctgcttcgccctgctgtggggctgtgcgctggccgcggccgcggcggcgcagggcaaggaagtggtactgctggactttgctgcagctggaggggagctcggctggctcacacacccgtatggcaaagggtgggacctgatgcagaacatcatgaatgacatgccgatctacatgtactccgtgtgcaacgtgatgtctggcgaccaggacaactggctccgcaccaactgggtgtaccgaggagaggctgagcgtaacaactttgagctcaactttactgtacgtgactgcaacagcttccctggtggcgccagctcctgcaaggagactttcaacctctactatgccgagtcggacctggactacggcaccaacttccagaagcgcctgttcaccaagattgacaccattgcgcccgatgagatcaccgtcagcagcgacttcgaggcacgccacgtgaagctgaacgtggaggagcgctccgtggggccgctcacccgcaaaggcttctacctggccttccaggatatcggtgcctgtgtggcgctgctctccgtccgtgtctactacaagaagtgccccgagctgctgcagggcctggcccacttccctgagaccatcgccggctctgatgcaccttccctggccactgtggccggcacctgtgtggaccatgccgtggtgccaccggggggtgaagagccccgtatgcactgtgcagtggatggcgagtggctggtgcccattgggcagtgcctgtgccaggcaggctacgagaaggtggaggatgcctgccaggcctgctcgcctggattttttaagtttgaggcatctgagagcccctgcttggagtgccctgagcacacgctgccatcccctgagggtgccacctcctgcgagtgtgaggaaggcttcttccgggcacctcaggacccagcgtcgatgccttgcacacgacccccttccgccccacactacctcacagccgtgggcatgggtgccaaggtggagctgcgctggacgccccctcaggacagcgggggccgcgaggacattgtctacagcgtcacctgcgaacagtgctggcccgagtctggggaatgcgggccgtgtgaggccagtgtgcgctactcggagcctcctcacggactgacccgcaccagtgtgacagtgagcgacctggagccccacatgaactacaccttcaccgtggaggcccgcaatggcgtctcaggcctggtaaccagccgcagcttccgtactgccagtgtcagcatcaaccagacagagccccccaaggtgaggctggagggccgcagcaccacctcgcttagcgtctcctggagcatccccccgccgcagcagagccgagtgtggaagtacgaggtcacttaccgcaagaagggagactccaacagctacaatgtgcgccgcaccgagggtttctccgtgaccctggacgacctggccccagacaccacctacctggtccaggtgcaggcactgacgcaggagggccagggggccggcagcaaggtgcacgaattccagacgctgtccccggagggatctggcaacttggcggtgattggcggcgtggctgtcggtgtggtcctgcttctggtgctggcaggagttggcttctttatccaccgcaggaggaagaaccagcgtgcccgccagtccccggaggacgtttacttctccaagtcagaacaactgaagcccctgaagacatacgtggacccccacacatatgaggaccccaaccaggctgtgttgaagttcactaccgagatccatccatcctgtgtcactcggcagaaggtgatcggagcaggagagtttggggaggtgtacaagggcatgctgaagacatcctcggggaagaaggaggtgccggtggccatcaagacgctgaaagccggctacacagagaagcagcgagtggacttcctcggcgaggccggcatcatgggccagttcagccaccacaacatcatccgcctagagggcgtcatctccaaatacaagcccatgatgatcatcactgagtacatggagaatggggccctggacaagttccttcgggagaaggatggcgagttcagcgtgctgcagctggtgggcatgctgcggggcatcgcagctggcatgaagtacctggccaacatgaactatgtgcaccgtgacctggctgcccgcaacatcctcgtcaacagcaacctggtctgcaaggtgtctgactttggcctgtcccgcgtgctggaggacgaccccgaggccacctacaccaccagtggcggcaagatccccatccgctggaccgccccggaggccatttcctaccggaagttcacctctgccagcgacgtgtggagctttggcattgtcatgtgggaggtgatgacctatggcgagcggccctactgggagttgtccaaccacgaggtgatgaaagccatcaatgatggcttccggctccccacacccatggactgcccctccgccatctaccagctcatgatgcagtgctggcagcaggagcgtgcccgccgccccaagttcgctgacatcgtcagcatcctggacaagctcattcgtgcccctgactccctcaagaccctggctgactttgacccccgcgtgtctatccggctccccagcacgagcggctcggagggggtgcccttccgcacggtgtccgagtggctggagtccatcaagatgcagcagtatacggagcacttcatggcggccggctacactgccatcgagaaggtggtgcagatgaccaacgacgacatcaagaggattggggtgcggctgcccggccaccagaagcgcatcgcctacagcctgctgggactcaaggaccaggtgaacactgtggggatccccatctgagcctcgacagggcctggagccccatcggccaagaatacttgaagaaacagagtggcctccctgctgtgccatgctgggccactggggactttatttatttctagttctttcctccccctgcaacttccgctgaggggtctcggatgacaccctggcctgaactgaggagatgaccagggatgctgggctgggccctctttccctgcgagacgcacacagctgagcacttagcaggcaccgccacgtcccagcatccctggagcaggagccccgccacagccttcggacagacatataggatattcccaagccgaccttccctccgccttctcccacatgaggccatctcaggagatggagggcttggcccagcgccaagtaaacagggtacctcaagccccatttcctcacactaagagggcagactgtgaacttgactgggtgagacccaaagcggtccctgtccctctagtgccttctttagaccctcgggccccatcctcatccctgactggccaaacccttgctttcctgggcctttgcaagatgcttggttgtgttgaggtttttaaatatatattttgtactttgtggagagaatgtgtgtgtgtggcagggggccccgccagggctggggacagagggtgtcaaacattcgtgagctggggactcagggaccggtgctgcaggagtgtcctgcccatgccccagtcggccccatctctcatccttttggataagtttctattctgtcagtgttaaagattttgttttgttggacatttttttcgaatcttaatttattattttttttatatttattgttagaaaatgacttatttctgctctggaataaagttgcagatgattcaaaccg

SEQ ID NO: 2 - DNA, 3949 bp, Homo sapiens
gaattccgccccgggaagcgcagccatggctctgcggaggctgggggccgcgctgctgctgctgccgctgctcgccgccgtggaagaaacgctaatggactccactacagcgactgctgagctgggctggatggtgcatcctccatcagggtgggaagaggtgagtggctacgatgagaacatgaacacgatccgcacgtaccaggtgtgcaacgtgtttgagtcaagccagaacaactggctacggaccaagtttatccggcgccgtggcgcccaccgcatccacgtggagatgaagttttcggtgcgtgactgcagcagcatccccagcgtgcctggctcctgcaaggagaccttcaacctctattactatgaggctgactttgactcggccaccaagaccttccccaactggatggagaatccatgggtgaaggtggataccattgcagccgacgagagcttctcccaggtggacctgggtggccgcgtcatgaaaatcaacaccgaggtgcggagcttcggacctgtgtcccgcagcggcttctacctggccttccaggactatggcggctgcatgtccctcatcgccgtgcgtgtcttctaccgcaagtgcccccgcatcatccagaatggcgccatcttccaggaaaccctgtcgggggctgagagcacatcgctggtggctgcccggggcagctgcatcgccaatgcggaagaggtggatgtacccatcaagctctactgtaacggggacggcgagtggctggtgcccatcgggcgctgcatgtgcaaagcaggcttcgaggccgttgagaatggcaccgtctgccgaggttgtccatctgggactttcaaggccaaccaaggggatgaggcctgtacccactgtcccatcaacagccggaccacttctgaaggggccaccaactgtgtctgccgcaatggctactacagagcagacctggaccccctggacatgccctgcacaaccatcccctccgcgccccaggctgtgatttccagtgtcaatgagacctccctcatgctggagtggacccctccccgcgactccggaggccgagaggacctcgtctacaacatcatctgcaagagctgtggctcgggccggggtgcctgcacccgctgcggggacaatgtacagtacgcaccacgccagctaggcctgaccgagccacgcatttacatcagtgacctgctggcccacacccagtacaccttcgagatccaggctgtgaacggcgttactgaccagagccccttctcgcctcagttcgcctctgtgaacatcaccaccaaccaggcagctccatcggcagtgtccatcatgcatcaggtgagccgcaccgtggacagcattaccctgtcgtggtcccagccagaccagcccaatggcgtgatcctggactatgagctgcagtactatgagaaggagctcagtgagtacaacgccacagccataaaaagccccaccaacacggtcaccgtgcagggcctcaaagccggcgccatctatgtcttccaggtgcgggcacgcaccgtggcaggctacgggcgctacagcggcaagatgtacttccagaccatgacagaagccgagtaccagacaagcatccaggagaagttgccactcatcatcggctcctcggccgctggcctggtcttcctcattgctgtggttgtcatcgccatcgtgtgtaacagacgggggtttgagcgtgctgactcggagtacacggacaagctgcaacactacaccagtggccacatgaccccaggcatgaagatctacatcgatcctttcacctacgaggaccccaacgaggcagtgcgggagtttgccaaggaaattgacatctcctgtgtcaaaattgagcaggtgatcggagcaggggagtttggcgaggtctgcagtggccacctgaagctgccaggcaagagagagatctttgtggccatcaagacgctcaagtcgggctacacggagaagcagcgccgggacttcctgagcgaagcctccatcatgggccagttcgaccatcccaacgtcatccacctggagggtgtcgtgaccaagagcacacctgtgatgatcatcaccgagttcatggagaatggctccctggactcctttctccggcaaaacgatgggcagttcacagtcatccagctggtgggcatgcttcggggcatcgcagctggcatgaagtacctggcagacatgaactatgttcaccgtgacctggctgcccgcaacatcctcgtcaacagcaacctggtctgcaaggtgtcggactttgggctctcacgctttctagaggacgatacctcagaccccacctacaccagtgccctgggcggaaagatccccatccgctggacagccccggaagccatccagtaccggaagttcacctcggccagtgatgtgtggagctacggcattgtcatgtgggaggtgatgtcctatggggagcggccctactgggacatgaccaaccaggatgtaatcaatgccattgagcaggactatcggctgccaccgcccatggactgcccgagcgccctgcaccaactcatgctggactgttggcagaaggaccgcaaccaccggcccaagttcggccaaattgtcaacacgctagacaagatgatccgcaatcccaacagcctcaaagccatggcgcccctctcctctggcatcaacctgccgctgctggaccgcacgatccccgactacaccagctttaacacggtggacgagtggctggaggccatcaagatggggcagtacaaggagagcttcgccaatgccggcttcacctcctttgacgtcgtgtctcagatgatgatggaggacattctccgggttggggtcactttggctggccaccagaaaaaaatcctgaacagtatccaggtgatgcgggcgcagatgaaccagattcagtctgtggagggccagccactcgccaggaggccacgggccacgggaagaaccaagcggtgccagccacgagacgtcaccaagaaaacatgcaactcaaacgacggaaaaaaaaagggaatgggaaaaaagaaaacagatcctgggagggggcgggaaatacaaggaatattttttaaagaggattctcataaggaaagcaatgactgttcttgcgggggataaaaaagggcttgggagattcatgcgatgtgtccaatcggagacaaaagcagtttctctccaactccctctgggaaggtgacctggccagagccaagaaacactttcagaaaaacaaatgtgaaggggagagacaggggccacccttggctcctgtccctgctgctcctctaggcctcactcaacaaccaagcgcctggaggacgggacagatggacagacagccaccctgagaacccctctgggaaaatctattcctgccaccactgggcaaacagaagaatttttctgtctttggagagtattttagaaactccaatgaaagacactgtttctcctgttggctcacagggctgaaaggggcttttgtcctcctgggtcagggagaacgcggggaccccagaaaggtcagccttcctgaggatgggcaacccccaggtctgcagctccaggtacatatcacgcgcacagcctggcagcctggccctcctggtgcccactcccgccagcccctgcctcgaggactgatactgcagtgactgccgtcagctccgactgccgctgagaagggttgatcctgcatctgggtttgtttacagcaattcctggactcgggggtattttggtcacagggtggttttggtttagggggtttgtttgttgggttgttttttgttttttggttttttttaatgacaatgaagtgacactttgacatttccaaaaaaaaaaaaaaaaaaaaaaaaaaaaaaaaaaaaa

SEQ ID NO: 3 - DNA, 2704 bp, Homo sapiens
gggagaaacgttctcactcgctctctgctcgctgcgggcgctccccgccctctgctgccagaaccttggggatgtgcctagacccggcgcagcacacgtccgggccaaccgcgagcagaacaaacctttggcgggcggccaggaggctccctcccagccaccgcccccctccagcgcctttttttccccccatacaatacaagatcttccttcctcagttcccttaaagcacagcccagggaaacctcctcacagttttcatccagccacgggccagcatgtctgggggcaaatacgtagactcggagggacatctctacaccgttcccatccgggaacagggcaacatctacaagcccaacaacaaggccatggcagacgagctgagcgagaagcaagtgtacgacgcgcacaccaaggagatcgacctggtcaaccgcgaccctaaacacctcaacgatgacgtggtcaagattgactttgaagatgtgattgcagaaccagaagggacacacagttttgacggcatttggaaggccagcttcaccaccttcactgtgacgaaatactggttttaccgcttgctgtctgccctctttggcatcccgatggcactcatctggggcatttacttcgccattctctctttcctgcacatctgggcagttgtaccatgcattaagagcttcctgattgagattcagtgcatcagccgtgtctattccatctacgtccacaccgtctgtgacccactctttgaagctgttgggaaaatattcagcaatgtccgcatcaacttgcagaaagaaatataaatgacatttcaaggatagaagtatacctgattttttttccttttaattttcctggtgccaatttcaagttccaagttgctaatacagcaacaatttatgaattgaattatcttggttgaaaataaaaagatcactttctcagttttcataagtattatgtctcttctgagctatttcatctatttttggcagtctgaatttttaaaacccatttaaatttttttccttacctttttatttgcatgtggatcaaccatcgctttattggctgagatatgaacatattgttgaaaggtaatttgagagaaatatgaagaactgaggaggaaaaaaaaaaaaaagaaaagaaccaacaacctcaactgcctactccaaaatgttggtcattttatgttaagggaagaattccagggtatggccatggagtgtacaagtatgtgggcagattttcagcaaactcttttcccactgtttaaggagttagtggattactgccattcacttcataatccagtaggatccagtgatccttacaagttagaaaacataatcttctgccttctcatgatccaactaatgccttactcttcttgaaattttaacctatgatattttctgtgcctgaatatttgttatgtagataacaagacctcagtgccttcctgtttttcacattttccttttcaaatagggtctaactcagcaactcgctttaggtcagcagcctccctgaagaccaaaattagaatatccatgacctagttttccatgcgtgtttctgactctgagctacagagtctggtgaagctcacttctgggcttcatctggcaacatctttatccgtagtgggtatggttgacactagcccaatgaaatgaattaaagtggaccaatagggctgagctctctgtgggctggcagtcctggaagccagctttccctgcctctcatcaactgaatgaggtcagcatgtctattcagcttcgtttattttcaagaataatcacgctttcctgaatccaaactaatccatcaccggggtggtttagtggctcaacattgtgttcccatttcagctgatcagtgggcctccaaggaggggctgtaaaatggaggccattgtgtgagcctatcagagttgctgcaaacctgacccctgctcagtaaagcacttgcaaccgtctgttatgctgtgacacatggcccctccccctgccaggagctttggacctaatccaagcatccctttgcccagaaagaagatgggggaggaggcagtaataaaaagattgaagtattttgctggaataagttcaaattcttctgaactcaaactgaggaatttcacctgtaaacctgagtcgtacagaaagctgcctggtatatccaaaagctttttattcctcctgctcatattgtgattctgcctttggggacttttcttaaaccttcagttatgatttttttttcatacacttattggaactctgcttgatttttgcctcttccagtcttcctgacactttaattaccaacctgttacctactttgactttttgcatttaaaacagacactggcatggatatagttttacttttaaactgtgtacataactgaaaatgtgctatactgcatactttttaaatgtaaagatatttttatctttatatgaagaaaatcacttaggaaatggctttgtgattcaatctgtaaactgtgtattccaagacatgtctgttctacatagatgcttagtccctcatgcaaatcaattactggtccaaaagattgctgaaattttatatgcttactgatatattttacaattttttatcatgcatgtcctgtaaaggttacaagcctgcacaataaaaatgtttaacggtt

SEQ ID NO: 4 - DNA, 1483 bp, Homo sapiens
ggggctcgggacggccgggctgggagctggagcccacagcgggaagcggccgccgcccgggcctcgcagggctaggcgaggcgagggggggcggggccgggcgctacgggaaggggaggccgcgcggaccgggagccgcaccgcgccagccgggctgcagcggccgcgcaccaaggctgcgatggggctggagacggagaaggcggacgtacagctcttcatggacgacgactcctacagccaccacagcggcctcgagtacgccgaccccgagaagttcgcggactcggaccaggaccgggatccccaccggctcaactcgcatctcaagctgggcttcgaggatgtgatcgcagagccggtgactacgcactcctttgacaaagtgtggatctgcagccatgccctctttgaaatcagcaaatacgtaatgtacaagttcctgacggtgttcctggccattcccctggccttcattgcgggaattctctttgccaccctcagctgtctgcacatctggattttaatgccttttgtaaagacctgcctaatggttctgccttcagtgcagacaatatggaagagtgtgacagatgttatcattgctccattgtgtacgagcgtaggacgatgcttctcttctgtcagcctgcaactgagccaggattgaatacttggaccccaggtctggagattgggatactgtaatacttctttgttattataacataaaagcaccactgttctgttcatttcctagctgttctaattaagaaaactattaagatgagcaaccacatttagaaatgtttattgacaggtcttttcaaataatgcttttctaattaatagccaaagatttcatatctaactttgtaaccagaattatacagtaagttgacaccacttagatttaaaggcagacagttttgctttagtacaatagtatacattttataatgatgaacttataatgattaagggacatttctataaaaatactacaatagttttatgcacaacttcccattaaaaatgagatttcttatttgtttgtctgtttttactctgggagtaatactttttaaattacctttacatatatagtcactggcatactgagaatatacaatgatcctggaaattgcagtaacaaaagcacacaacgattatagtaactataagatacaataaaacaaataaatgtgaaagtagattcatgaaaatgtattcctttaaaatattgttttcctacaggcctatttaacaagatgtttcattttactgtatattttgtagttaatataaatgttgctctaatcagattgcttaaaagcatttttattatatttatgttgttgaactaatatatgaaataagtaaatgtagctcccacaaggtaaacttcattggtaagattgcactgttctgattatgtaagcatttgtacatcttctttggaaataaaagataaaagagcgat

SEQ ID NO: 5 - DNA, 1399 bp, Homo sapiens
agtgtgaaatcttcagagaagaatttctctttagttctttgcaagaaggtagagataaagacactttttcaaaaatggcaatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaagcccctggatgaaacacttaagaaagcccttacaggtcaccttgaggaggttgttttagctctgctaaaaactccagcgcaatttgatgctgatgaacttcgtgctgccatgaagggccttggaactgatgaagatactctaattgagattttggcatcaagaactaacaaagaaatcagagacattaacagggtctacagagaggaactgaagagagatctggccaaagacataacctcagacacatctggagattttcggaacgctttgctttctcttgctaagggtgaccgatctgaggactttggtgtgaatgaagacttggctgattcagatgccagggccttgtatgaagcaggagaaaggagaaaggggacagacgtaaacgtgttcaataccatccttaccaccagaagctatccacaacttcgcagagtgtttcagaaatacaccaagtacagtaagcatgacatgaacaaagttctggacctggagttgaaaggtgacattgagaaatgcctcacagctatcgtgaagtgcgccacaagcaaaccagctttctttgcagagaagcttcatcaagccatgaaaggtgttggaactcgccataaggcattgatcaggattatggtttcccgttctgaaattgacatgaatgatatcaaagcattctatcagaagatgtatggtatctccctttgccaagccatcctggatgaaaccaaaggagattatgagaaaatcctggtggctctttgtggaggaaactaaacattcccttgatggtctcaagctatgatcagaagactttaattatatattttcatcctataagcttaaataggaaagtttcttcaacaggattacagtgtagctacctacatgctgaaaaatatagcctttaaatcatttttatattataactctgtataatagagataagtccattttttaaaaatgttttccccaaaccataaaaccctatacaagttgttctagtaacaatacatgagaaagatgtctatgtagctgaaaataaaatgacgtcacaagac

SEQ ID NO: 6 - DNA, 1362 bp, Homo sapiens
catttggggacgctctcagctctcggcgcacggcccagcttccttcaaaatgtctactgttcacgaaatcctgtgcaagctcagcttggagggtgatcactctacacccccaagtgcatatgggtctgtcaaagcctatactaactttgatgctgagcgggatgctttgaacattgaaacagccatcaagaccaaaggtgtggatgaggtcaccattgtcaacattttgaccaaccgcagcaatgcacagagacaggatattgccttcgcctaccagagaaggaccaaaaaggaacttgcatcagcactgaagtcagccttatctggccacctggagacggtgattttgggcctattgaagacacctgctcagtatgacgcttctgagctaaaagcttccatgaaggggctgggaaccgacgaggactctctcattgagatcatctgctccagaaccaaccaggagctgcaggaaattaacagagtctacaaggaaatgtacaagactgatctggagaaggacattatttcggacacatctggtgacttccgcaagctgatggttgccctggcaaagggtagaagagcagaggatggctctgtcattgattatgaactgattgaccaagatgctcgggatctctatgacgctggagtgaagaggaaaggaactgatgttcccaagtggatcagcatcatgaccgagcggagcgtgccccacctccagaaagtatttgataggtacaagagttacagcccttatgacatgttggaaagcatcaggaaagaggttaaaggagacctggaaaatgctttcctgaacctggttcagtgcattcagaacaagcccctgtattttgctgatcggctgtatgactccatgaagggcaaggggacgcgagataaggtcctgatcagaatcatggtctcccgcagtgaagtggacatgttgaaaattaggtctgaattcaagagaaagtacggcaagtccctgtactattatatccagcaagacactaagggcgactaccagaaagcgctgctgtacctgtgtggtggagatgactgaagcccgacacggcctgagcgtccagaaatggtgctcaccatgcttccagctaacaggtctagaaaaccagcttgcgaataacagtccccgtggccatccctgtgagggtgacgttagcattacccccaacctcattttagttgcctaagcattgcctggccttcctgtctagtctctcctgtaagccaaagaaatgaacattccaaggagttggaagtgaagtctatgatgtgaaacactttgcctcctgtgtactgtgtcataaacagatgaataaactgaatttgtacttt

SEQ ID NO: 7 - DNA, 691 bp, Homo sapiens
gaaaaagacactcatcactttcgtgaacaagcacctgaataaactgaacctggaggtcacagaactggaaacccagtttgcagatggggtgtacctggtgctgctcatggggctcctggagggctactttgtgcccctgcacagcttcttcctgaccccggacagctttgaacagaaggtcttgaatgtctcctttgcctttgagctcatgcaagatggagggttggaaaagccaaaaccgcggccagaagacatagtcaactgtgacctgaaatctacactacgagtgttgtacaacctcttcaccaagtaccgtaacgtggagtgaggggctgccctgggcccaccactgcccaagagttcgttgcgtgttggcgtactggaccctcctccgaactgccttaccctgcttattcctgtctcttgcactgtgctctcccacaagtccagctgcaacccagagatagtggaaactgaaattaggaaggaaatcatcaataactcagtgggctgacccatccctcccaggcgctggggaccaacctagcaatgaaggttgggaaggttgttcccttcccggtgccaggtccagatttccctccatgatgtgggaaccaggttaggcagaaagagtccccacaatgatgaaaataagagatcctagttaccattcagaataagaaaacaacag

SEQ ID NO: 8 - DNA, 878 bp, Homo sapiens
ttttttttttttttaagtggtaaaaaaaatttggttatttataaatcaattacacaataaaataattatttttaaaagtcacaaatacaatcgtggtataaagtcatttgggcatcaagtatctcttaaatatgtggcaaactatttgtccaaagagatgtggtccaaacccgtcgaaggctttataatttggtattagataacaaggtgaacaaaactgacaataaatactccaacgaattattttttaaaatactaaggggcaaaggctattctaaggggcaaaacaatctattactcagacctacctgaaaatttcacgtgaagtcgatcaaaagttatacaaaattggtatttacatgtttaaaatccggattggcatttttctttaataataatacatacaaaaactcagagggttaataaagaaataattcaaagtcctaataagtcaacaaacagatttcattataagctggaacataaaagagacaccatggttggctgtctcttttcaaaaattatcacggccacttggtcaaacgggaagcagcattcagaacaatggttctcaaatctcggggtggcataaacaccatgcaggttggttaccacacagattcctgggcctgttcccagtctgaagctctcataaaggatctgaggaatctgcttcgtgacaagattcagactatttatttatttatcacccaagctggagtgcaggggtgcaacccggtcaggaaacctcgcctcggagtaaaagggaaaccaaatcggggcccaggccctgagaatgggttcaaacgggcccaccaccggtaacggtatcagaaaaaaacggtccagaaggccaggggtcaaccgaaccaagaagc

SEQ ID NO: 9 - DNA, 2153 bp, Homo sapiens
aagactgcgagctccccgcaccccctcgcactccctctggccggcccagggcgccttcagcccaacctccccagccccacgggcgccacggaacccgctcgatctcgccgccaactggtagacatggagacccctgcctggccccgggtcccgcgccccgagaccgccgtcgctcggacgctcctgctcggctgggtcttcgcccaggtggccggcgcttcaggcactacaaatactgtggcagcatataatttaacttggaaatcaactaatttcaagacaattttggagtgggaacccaaacccgtcaatcaagtctacactgttcaaataagcactaagtcaggagattggaaaagcaaatgcttttacacaacagacacagagtgtgacctcaccgacgagattgtgaaggatgtgaagcagacgtacttggcacgggtcttctcctacccggcagggaatgtggagagcaccggttctgctggggagcctctgtatgagaactccccagagttcacaccttacctggagacaaacctcggacagccaacaattcagagttttgaacaggtgggaacaaaagtgaatgtgaccgtagaagatgaacggactttagtcagaaggaacaacactttcctaagcctccgggatgtttttggcaaggacttaatttatacactttattattggaaatcttcaagttcaggaaagaaaacagccaaaacaaacactaatgagtttttgattgatgtggataaaggagaaaactactgtttcagtgttcaagcagtgattccctcccgaacagttaaccggaagagtacagacagcccggtagagtgtatgggccaggagaaaggggaattcagagaaatattctacatcattggagctgtggtatttgtggtcatcatccttgtcatcatcctggctatatctctacacaagtgtagaaaggcaggagtggggcagagctggaaggagaactccccactgaatgtttcataaaggaagcactgttggagctactgcaaatgctatattgcactgtgaccgagaacttttaagaggatagaatacatggaaacgcaaatgagtatttcggagcatgaagaccctggagttcaaaaaactcttgatatgacctgttattaccattagcattctggttttgacatcagcattagtcactttgaaatgtaacgaatggtactacaaccaattccaagttttaatttttaacaccatggcaccttttgcacataacatgctttagattatatattccgcacttaaggattaaccaggtcgtccaagcaaaaacaaatgggaaaatgtcttaaaaaatcctgggtggacttttgaaaagcttttttttttttttttttttgagacggagtcttgctctgttgcccaggctggagtgcagtagcacgatctcggctcacttgcaccctccgtctctcgggttcaagcaattgtctgcctcagcctcccgagtagctgggattacaggtgcgcactaccacgccaagctaatttttgtattttttagtagagatggggtttcaccatcttggccaggctggtcttgaattcctgacctcagtgatccacccaccttggcctcccaaagatgctagtattatgggcgtgaaccaccatgcccagccgaaaagcttttgaggggctgacttcaatccatgtaggaaagtaaaatggaaggaaattgggtgcatttctaggacttttctaacatatgtctataatatagtgtttaggttcttttttttttcaggaatacatttggaaattcaaaacaattgggcaaactttgtattaatgtgttaagtgcaggagacattggtattctgggcagcttcctaatatgctttacaatctgcactttaactgacttaagtggcattaaacatttgagagctaactatatttttataagactactatacaaactacagagtttatgatttaaggtacttaaagcttctatggttgacattgtatatataattttttaaaaaggtttttctatatggggattttctatttatgtaggtaatattgttctatttgtatatattgagataatttatttaatatactttaaataaaggtgactgggaattgtt

SEQ ID NO: 10 - DNA, 539 bp, Homo sapiens
gaggaccccggcggcgccgcagtcccgcgagccatggcccagtccggcggggaggctcggcccgggcccaagacggcggtgcagatccgcgtcgccatccaggaggccgaggacgtggacgagttggaggacgaggaggagggggcggagactcggggcgccggggacccggcccggtacctcagccccggctggggcagcgcgagcgaggaggagccgagccgcgggcacaggaataggagctcggtgaattcaaggaccatgcttgcttcgttcattgtatcttcagcacctagcacagcacccagcacataggacatgtttgttgactgaatgcgtatctctatcatcacactcactcaatggtgttgagatatttgtgtttccccttccctagacagtgagatccttgaaggcagctgccttatcttattcctttttgtatttccatacctagcctaatacctagcttatataagggaacagaataaatgaacaataaagaaaagtctttacagcctctaaaaaaaaaaaaaaag

SEQ ID NO: 11 - DNA, 725 bp, Homo sapiens
  misc_feature (645)..(645): n is a, c, g, or t
ttttttttcctgctctttatttgattttattctttgaaaaaaacagatatgagaattgccgatgcacaggccaacctgtgctaccatatgtgggctttgaaaagattctggattttctgtctgtatgataatatgtgctgctgtatagagcaaggaaaacagaggtggttttccaagctccacagcccatctttatcactgccaggtaaagctctgtcccttaaaagttagatacaaccaaccaagtgacatttattgagactctactatgtgccagacctgggcaaggtaccttctcataaggtcgagctggatgactggctgggataaaggatacagccaaaacgtgggggtccaacaggaggtcgtggggaccacatgctcatccacaggacctgatctaagcttgttcatagaccttctgtgtattttccttatagaaaataagaggattgtgcttatcatttcttttccattgttgtcagtttcagttttttatatgtcctaataaccatatatttcattttccacccatccagactccttactcctccccatttggtctggggagaactcataaatgtcattggtcacaaatccactctccacgctcaccagagtcacaaacccactttctgatgggtnacagccatgttgtcatagtcacaagacatgtcatcgggaagtgcttctcccggacacactccgtatgaaatattcttcag

SEQ ID NO: 12 - DNA, 970 bp, Homo sapiens
cggacagatctctgggtggctggcggtcatggcgctactagatgtatgcggagccccccgagggcagcggccggaatcggctctcccggttgcgggaagcgggcgtcgctcggaccgtcctgactacagtttctctatgcgatctccagagctcgctttaccccggggaatgaagcccacagaattcttccagtccctgggtggggacggagaaaggaacgttcagattgagatggcccatggcaccaccacgctcgccttcaagttccagcatggagtgattgcagcagtggattctcgggcctcagctgggtcctacattagtgccttacgggtgaacaaggtgattgagattaacccttacctgcttggcaccatgtctggctgtgcagcagactgtcagtactgggagcgcctgctggccaaggaatgcaggctgtactatctgcgaaatggagaacgtatttcagtgtcggcagcctccaagctgctgtccaacatgatgtgccagtaccggggcatgggcctctctatgggcagtatgatctgtggctgggataagaagggtcctggactctactacgtggatgaacatgggactcggctctcaggaaatatgttctccacgggtagtgggaacacttatgcctacggggtcatggacagtggctatcggcctaatcttagccctgaagaggcctatgaccttggccgcagggctattgcttatgccactcacagagacagctattctggaggcgttgtcaatatgtaccacatgaaggaagatggttgggtgaaagtagaaagtacagatgtcagtgacctgctgcaccagtaccgggaagccaatcaataatggtggtggtggcagctgggcaggtctcctctgggaggtcttggccgactcagggacctaagccacgttaagtccaaggagaagaagaggcctagcctgagccaaagagag

SEQ ID NO: 13 - DNA, 2699 bp, Homo sapiens
ggcacgaggcaggcggcgaggagagcggtgccttgcagggatgctgcgggcgggagcaccaaccggggacttaccccgggcgggagaagtccacaccgggaccaccatcatggcagtggagtttgacgggggcgttgtgatgggttctgattcccgagtgtctgcaggcgaggcggtggtgaaccgagtgtttgacaagctgtccccgctgcacgagcgcatctactgtgcactctctggttcagctgctgatgcccaagccgtggccgacatggccgcctaccagctggagctccatgggatagaactggaggaacctccacttgttttggctgctgcaaatgtggtgagaaatatcagctataaatatcgagaggacttgtctgcacatctcatggtagctggctgggaccaacgtgaaggaggtcaggtatatggaaccctgggaggaatgctgactcgacagccttttgccattggtggctccggcagcacctttatctatggttatgtggatgcagcatataagccaggcatgtctcccgaggagtgcaggcgcttcaccacagacgctattgctctggccatgagccgggatggctcaagcgggggtgtcatctacctggtcactattacagctgccggtgtggaccatcgagtcatcttgggcaatgaactgccaaaattctatgatgagtgaaccttccccagacttctctttcttattttgtaataaactctctagggccaaaacctggtatggtcattgggaaatgagtgctcagggagatggagcttaggggaggtgggtgcttccctcctagatgtcagcatacactctttcttcttttgtcccaggtctaaaacatctttcctagagaaaacaaaagggactaaactagaaatataaagagccctatacatgacaggtgatcacgtactgaatgattttgtagtacaaacaataaaaattctcattccgcatcatcatgcggtccatgatgatgaggccgcaaaaaaaaaaaaaaaaaaaaaaaactcgagactagttctctctctctccctcgtgccgaattcggcacgaggtgtaatcccagctactcgggaggctgagacagaagaatcacttgagcccaggaggcggaggttgcggtgagcagagattgcgccattgcactccagcctgggcgacaaagcgagactccatctcaaaaaaaacaaaaaaattagcatttacggaattctgaaattttgggctattaaatttctacatcatctaagtgccctcttggcaatctttcacatcctctcatggcatctgatccagaaggctcaaacctgatctgagtactagtgtgttcctcctactcacttctgtttctattaactaataagtgtagtaatgaaagccagtattagggacaaattttacatgactttcttctcaaacctggacctttattgaacctctgcctccctttttcattagtatgaaagtatgtatcttaaagggttgctctacgaattaaatggatcagtaaatataaagaaagcgcctagcaaagtgcctagtacaaaataaacgcccaactgttattgttactattgttttaaattctagtttccttaccccttaacatacattttcagttatacaaaagttgaacgtttccctggagattgccaaaattctctgaacggtttcaagagatctgtcctattcttcacctacacacaaaaaagtactaatcatcacacacaggctacctaagccacctgaccttacctcccattagctgtccctgtaccatctaactaaaatgtacagatacatacttgtggccaggcacggtggctcacgcctgtaatcacagcactttgggaggccaaggcaggcggatcacctgaggtcaggagtttcagactagtctggccaacatggagaaaccccgtttctactaaaaatgcaaaaattagctgggcttggtggtgcacacctgtagtgccagctactcgcgagactgaggcaggagaattgcttgaacccgggaggcgggggttgcagtgagccgagatccggccactacactccagcctgggaaacagagcgatactctgtctcaaaaaaacagaaagacaaaaaaacggatacatactggaaccctgaaaactttttcagtagcatttagaccttctctcatatacagcattgtaaaatccattgctttgcttttagctgcactatgtgccccaatatcatcaaatggcatttggccttctctttacagactgaaaaggcacattacagatcttaaatatgctagtagtagatcaatgggcagtgtgttattcagaatacagtattctgtgatggttttctaatctcagtgacagtaggtggttaaattaaatgtttatggccaggtgcggtggctcacacctataatcccagcactttgggaggccaagccaaggtgggcagatcttttaaggtcaggagttcaagatcagcctgaccaatatggtgaaagcctgtctccactgaaaatacaaaaaattagctgggtgtggtggcgcacccctgtaatctcagctacccgggaggtagagtttgcagtgagcagagattgtgccactgcactccagtctggacgacagagtgagactccatctcaaaaataaaaaaaaaaaaaaaaaaa

SEQ ID NO: 14 - DNA, 2415 bp, Homo sapiens
cggcgccgcgagcttctcctctcctcacgaccgaggcagagcagtcattatggcgaaccttggctgctggatgctggttctctttgtggccacatggagtgacctgggcctctgcaagaagcgcccgaagcctggaggatggaacactgggggcagccgatacccggggcagggcagccctggaggcaaccgctacccacctcagggcggtggtggctgggggcagcctcatggtggtggctgggggcagcctcatggtggtggctgggggcagccccatggtggtggctggggacagcctcatggtggtggctggggtcaaggaggtggcacccacagtcagtggaacaagccgagtaagccaaaaaccaacatgaagcacatggctggtgctgcagcagctggggcagtggtggggggccttggcggctacatgctgggaagtgccatgagcaggcccatcatacatttcggcagtgactatgaggaccgttactatcgtgaaaacatgcaccgttaccccaaccaagtgtactacaggcccatggatgagtacagcaaccagaacaactttgtgcacgactgcgtcaatatcacaatcaagcagcacacggtcaccacaaccaccaagggggagaacttcaccgagaccgacgttaagatgatggagcgcgtggttgagcagatgtgtatcacccagtacgagagggaatctcaggcctattaccagagaggatcgagcatggtcctcttctcctctccacctgtgatcctcctgatctctttcctcatcttcctgatagtgggatgaggaaggtcttcctgttttcaccatctttctaatctttttccagcttgagggaggcggtatccacctgcagcccttttagtggtggtgtctcactctttcttctctctttgtcccggataggctaatcaatacccttggcactgatgggcactggaaaacatagagtagacctgagatgctggtcaagccccctttgattgagttcatcatgagccgttgctaatgccaggccagtaaaagtataacagcaaataaccattggttaatctggacttatttttggacttagtgcaacaggttgaggctaaaacaaatctcagaacagtctgaaatacctttgcctggatacctctggctccttcagcagctagagctcagtatactaatgccctatcttagtagagatttcatagctatttagagatattttccattttaagaaaacccgacaacatttctgccaggtttgttaggaggccacatgatacttattcaaaaaaatcctagagattcttagctcttgggatgcaggctcagcccgctggagcatgagctctgtgtgtaccgagaactggggtgatgttttacttttcacagtatgggctacacagcagctgttcaacaagagtaaatattgtcacaacactgaacctctggctagaggacatattcacagtgaacataactgtaacatatatgaaaggcttctgggacttgaaatcaaatgtttgggaatggtgcccttggaggcaacctcccattttagatgtttaaaggaccctatatgtggcattcctttctttaaactataggtaattaaggcagctgaaaagtaaattgccttctagacactgaaggcaaatctcctttgtccatttacctggaaaccagaatgattttgacatacaggagagctgcagttgtgaaagcaccatcatcatagaggatgatgtaattaaaaaatggtcagtgtgcaaagaaaagaactgcttgcatttctttatttctgtctcataattgtcaaaaaccagaattaggtcaagttcatagtttctgtaattggcttttgaatcaaagaatagggagacaatctaaaaaatatcttaggttggagatgacagaaatatgattgatttgaagtggaaaaagaaattctgttaatgttaattaaagtaaaattattccctgaattgtttgatattgtcacctagcagatatgtattacttttctgcaatgttattattggcttgcactttgtgagtatctatgtaaaaatatatatgtatataaaatatatattgcataggacagacttaggagttttgtttagagcagttaacatctgaagtgtctaatgcattaacttttgtaaggtactgaatacttaatatgtgggaaacccttttgcgtggtccttaggcttacaatgtgcactgaatcgtttcatgtaagaatccaaagtggacaccattaacaggtctttgaaatatgcatgtactttatattttctatatttgtaactttgcatgttcttgttttgttatataaaaaaattgtaaatgtttaatatctgactgaaattaaacgagcgaagatgagcacc

SEQ ID NO: 15 - DNA, 1204 bp, Homo sapiens
ctctgaggagaagcagcagcaaacatttgctagtcagacaagtgacagggaatggattccaaacagcagtgtgtaaagctaaatgatggccacttcatgcctgtattgggatttggcacctatgcacctccagaggttccgagaagtaaagctttggaggtcacaaaattagcaatagaagctgggttccgccatatagattctgctcatttatacaataatgaggagcaggttggactggccatccgaagcaagattgcagatggcagtgtgaagagagaagacatattctacacttcaaagctttggtccacttttcatcgaccagagttggtccgaccagccttggaaaactcactgaaaaaagctcaattggactatgttgacctctatcttattcattctccaatgtctctaaagccaggtgaggaactttcaccaacagatgaaaatggaaaagtaatatttgacatagtggatctctgtaccacctgggaggccatggagaagtgtaaggatgcaggattggccaagtccattggggtgtcaaacttcaaccgcaggcagctggagatgatcctcaacaagccaggactcaagtacaagcctgtctgcaaccaggtagaatgtcatccgtatttcaaccggagtaaattgctagatttctgcaagtcgaaagatattgttctggttgcctatagtgctctgggatctcaacgagacaaacgatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtttttgagttccagttgactgcagaggacatgaaagccatagatggcctagacagaaatctccactattttaacagtgatagttttgctagccaccctaattatccatattcagatgaatattaacatggagagctttgcctgatgtctaccagaagccctgtgtgtggatggtgacgcagaggacgtctctatgccggtgactggacatatcacctctacttaaatccgtcctgtttagcgacttcagtcaactacagctgagtccataggccagaaagacaataaatttttatcattttgaaat

SEQ ID NO: 16 - DNA, 3879 bp, Homo sapiens
gcacctgggcacctgggcagccgccgcggcgctggctagacgtgcgcgatggagggcgacggcgggaccccatgggccctggcgctgctgcgcaccttcgacgcgggcgagttcacgggctgggagaaggtgggctcgggcggcttcgggcaggtgtacaaggtgcgccatgtccactggaagacctggctggccatcaagtgctcgcccagcctgcacgtcgacgacagggagcgcatggagcttttggaagaagccaagaagatggagatggccaagtttcgctacatcctgcctgtgtatggcatctgccgcgaacctgtcggcctggtcatggagtacatggagacgggctccctggaaaagctgctggcttcggagccattgccatgggatctccggttccgaatcatccacgagacggcggtgggcatgaacttcctgcactgcatggccccgccactcctgcacctggacctcaagcccgcgaacatcctgctggatgcccactaccacgtcaagatttctgattttggtctggccaagtgcaacgggctgtcccactcgcatgacctcagcatggatggcctgtttggcacaatcgcctacctccctccagagcgcatcagggagaagagccggctcttcgacaccaagcacgatgtatacagctttgcgatcgtcatctggggcgtgctcacacagaagaagccgtttgcagatgagaagaacatcctgcacatcatggtgaaggtggtgaagggccaccgccccgagctgccgcccgtgtgcagagcccggccgcgcgcctgcagccacctgatacgcctcatgcagcggtgctggcagggggatccgcgagttaggcccaccttccaagaaattacttctgaaaccgaggacctgtgtgaaaagcctgatgacgaagtgaaagaaactgctcatgatctggacgtgaaaagccccccggagcccaggagcgaggtggtgcctgcgaggctcaagcgggcctctgcccccaccttcgataacgactacagcctctccgagcttctctcacagctggactctggagtttcccaggctgtcgagggccccgaggagctcagccgcagctcctctgagtccaagctgccatcgtccggcagtgggaagaggctctcgggggtgtcctcggtggactccgccttctcttccagaggatcactgtcgctgtcctttgagcgggaaccttcaaccagcgatctgggtaccacagacgtccagaagaagaagcttgtggatgccatcgtgtccggggacaccagcaaactgatgaagatcctgcagccgcaggacgtggacctggcactggacagcggtgccagcctgctgcacctggcggtggaggccgggcaagaggagtgcgccaagtggctgctgctcaacaatgccaaccccaacctgagcaaccgtaggggctccaccccgttgcacatggccgtggagaggagggtgcggggtgtcgtggagctcctgctggcacggaagatcagtgtcaacgccaaggatgaggaccagtggacagccctccactttgcagcccagaacggggatgagtctagcacacggctgctgttggagaagaacgcctcggtcaacgaggtggactttgagggccggacgcccatgcacgtggcctgccagcacgggcaggagaatatcgtgcgcatcctgctgcgccgaggcgtggacgtgagcctgcagggcaaggatgcctggctgccactgcactacgctgcctggcagggccacctgcccatcgtcaagctgctggccaagcagccgggggtgagtgtgaacgcccagacgctggatgggaggacgccattgcacctggccgcacagcgcgggcactaccgcgtggcccgcatcctcatcgacctgtgctccgacgtcaacgtctgcagcctgctggcacagacacccctgcacgtggccgcggagacggggcacacgagcactgccaggctgctcctgcatcggggcgctggcaagaaggccgtgacctcagacggctacaccgctctgcacctggctgcccgcaacggacacctggccactgtcaagctgcttgtcgaggagaaggccgatgtgctggcccggggacccctgaaccagacggcgctgcacctggctgccgcccacgggcactcggaggtggtggaggagttggtcagcgccgatgtcattgacctgttcgacgagcaggggctcagcgcgctgcacctggccgcccagggccggcacgcacagacggtggagactctgctcaggcatggggcccacatcaacctgcagagcctcaagttccagggcggccatggccccgccgccacactcctgcggcgaagcaagacctagctggctgcctgcggagaccgggggtccacgtggggctcttgtcctgtcctgtgttcctcgtggggatggaacgatcctgcgtggggccccgttgtggcttacctaaatgttaaccaagcagaggtgacatggtgccatcaggaggcggctgctgctgaccggagtgtcccctccaggtgaagctggctcaggtgcacatgcccgctccatcatcgatctaggcacctgctgtctgaagggaccgtgggtcagaatcatttcgttgtgctcctaatgggtcgctgaggctggtctctcagtgatgaagccccaggcgtggaagcatccactctctcctgaggcgagccaccttgggttgctggagctcaccagtcttgagggaggtgcaggggaaactgtgttttttatcttcatatatgacggtgggcagagaggcctgtcttaaagtttccatggaattgttttataaaatatcttaagagatgaataccttatcagctgttgcttgaaacctgttaaaaatgttcataacattggatagtctagtctctaaatgatggctaagtagtggggttggctttgaaaacaatgttttatgcaacaaggaacgaatggtagcagccagctttgcggggcgtatgtgtggccagctcttaaccattccagtctattacttgggtgagtccttgtggacaaccacacacacgtgcccacatggtactagctgccgttcgtttctcgttgcctaagatgttttggcaactctagagccacaggcctaagagtcattaaaaaattctccctttgtaacctcagtgctggggactgaggcgagccccctcaggtcgctggagtgcaccagtcttggggaagaggtgcaggagaagctgtgttttttatctccacacgcagtatgaagataaaattacatagtattacctagacatagacagtattacctaggtagatgcactgctcacctgcacccttcccagctctcatttttgttaggtgatttgggatagggatagtgttttggggtatggggggagtgtttctgacctgctttgcagacgtgcctccgcacctcagcagtttggggtgtggccccagggcggttcttggatgtaaaagatgtggccatctagcctcgtaacttcactgtcacctgtgtcccatagggtgccttctgaatactgttattagaataagtttgttgcagaacgtgaccctgcgtgcaaacatgtaccgtggcctggtatatgatagagattgatattaatgtaccatgtatgttaatgtgaatctgtgggcaggatacttttccatggcaggaaatatccaagctgttgaaactggctatgttttaatatgcctcattgtgcctttactgttgtgtggactgcgtgagggacaagaagttccatttgatgtcaataaagcaaagtacttgcctacttttttgaaaaaaaaaaa

SEQ ID NO: 17 - DNA, 4151 bp, Homo sapiens
gggaatagcagaataggagcaagccagcactagtcagctaactaagtgactcaaccaaggccttttttccttgttatctttgcagatacttcattttcttagcgtttctggagattacaacatcctgcggttccgtttctgggaactttactgatttatctcccccctcacacaaataagcattgattcctgcatttctgaagatctcaagatctggactactgttgaaaaaatttccagtgaggctcacttatgtctgtaaagatgggaaaaaaatacaagaacattgttctactaaaaggattagaggtcatcaatgattatcattttagaatggttaagtccttactgagcaacgatttaaaacttaatttaaaaatgagagaagagtatgacaaaattcagattgctgacttgatggaagaaaagttccgaggtgatgctggtttgggcaaactaataaaaattttcgaagatataccaacgcttgaagacctggctgaaactcttaaaaaagaaaagttaaaagtaaaaggaccagccctatcaagaaagaggaagaaggaagtgcatgctacttcacctgcaccctccacaagcagcactgtcaaaactgaaggagcagaggcaactcctggagctcagaaaagaaaaaaatcaaccaaagaaaaggctggacccaaagggagtaaggtgtccgaggaacagactcagcctccctctcctgcaggagccggcatgtccacagccatgggccgttccccatctcccaagacctcattgtcagctccacccaacagttcttcaactgagaacccgaaaacagtggccaaatgtcaggtaactcccagaagaaatgttctccaaaaacgcccagtgatagtgaaggtactgagtacaacaaagccatttgaatatgagaccccagaaatggagaaaaaaataatgtttcatgctacagtggctacacagacacagttcttccatgtgaaggttttaaacaccagcttgaaggagaaattcaatggaaagaaaatcatcatcatatcagattatttggaatatgatagtctcctagaggtcaatgaagaatctactgtatctgaagctggtcctaaccaaacgtttgaggttccaaataaaatcatcaacagagcaaaggaaactctgaagattgatattcttcacaaacaagcttcaggaaatattgtatatggggtatttatgctacataagaaaacagtaaatcagaagaccacaatctacgaaattcaggatgatagaggaaaaatggatgtagtggggacaggacaatgtcacaatatcccctgtgaagaaggagataagctccagcttttctgctttcgacttagaaaaaagaaccagatgtcaaaactgatttcagaaatgcatagttttatccagataaagaaaaaaacaaacccgagaaacaatgaccccaagagcatgaagctaccccaggaacagcgtcagcttccatatccttcagaggccagcacaaccttccctgagagccatcttcggactcctcagatgccaccaacaactccatccagcagtttcttcaccaagaaaagtgaagacacaatctccaaaatgaatgacttcatgaggatgcagatactgaaggaagggagtcattttccaggaccgttcatgaccagcataggcccagctgagagccatccccacactcctcagatgcctccatcaacaccaagcagcagtttcttaaccacgttgaaaccaagactgaagactgaacctgaagaagtttccatagaagacagtgcccagagtgacctcaaagaagtgatggtgctgaacgcaacagaatcatttgtatatgagcccaaagagcagaagaaaatgtttcatgccacagtggcaactgagaatgaagtcttccgagtgaaggtttttaatattgacctaaaggagaagttcaccccaaagaagatcattgccatagcaaattatgtttgccgcaatgggttcctggaggtatatcctttcacacttgtggctgatgtgaatgctgaccgaaacatggagatcccaaaaggattgattagaagtgccagcgtaactcctaaaatcaatcagctttgctcacaaactaaaggaagttttgtgaatggggtgtttgaggtacataaggtaagcccacaccattgttttataaaatttctcctgcaacctccaatttttaaagtcttaacttgtcaactggagtttggtcaacttactcaacacagaaaatcaaccccttcacccttcccccagcactagagataattgaatagagttcatttcaggatatggggtacgttatattgtaacattcctcttcttaaggtatcatcatgcaagttatttagacagtcactaggaaacttggcattttattagttttgatgatctattcagagccacccttgtccaggacagtgcagagtttatatcaacacacatatccttaggattttgtttctttgagttcttctccatctgtatcaatgacaacttaatttaattgtgaataaaagagttgctctcccaagcctgaatcctgattgtgacaaccagagtaagaaataaaatagactactctgctttagaatgcagctatgtctaacagttagctagaattctgatcatttggactccaaagtttcttgcctcttctcattcattaattcatcaggagactgtagagcaactaacttctgcattaaataataagagaaatacgaagcaaaaagactaaaaaagtcacgtagcttaactgctcaatttataaatggggcaataaaatgcaaaaaaaaagaaaaaaagcttggtgaattcttaggcttacagtgtgcctttcagtctctacacatcatgtaaatattatgcttagctgatttaacttcttgtttgaagtactgtttcatactccattatacatgtcttctagggtggcttacttttaattgtgctgttttctctacactcagtttaaatgactgtacatatatatgtggttggagagttaatgaataatgagctacaaaccagaacaatgtgactagatagataggatgatctagaattgagaactggcagattgggaaaagagtggctatatggagaaagaaagaaagtagttccatattgaaataacagtctacttaatgaggaccgttgcaacattctttctcaaacttacaaagtgccataaaaagcctctattctctgctcttgggcaggtgtgaaagaaacctaccaaattaatcagatttttctgtatccaggctccttaaaaaatcccagctgtgctgatgtggaaacaggaagaattaggaaagtaatcaattttttttcctagaaaaaatccagcagacaaagaacttcaacaaaagaggctcaagggaggagttgaaaggcaggattcaaagaccaagtatcttaagctatttggtacctgttattcaggacctacagctctgtttactctatcaaagaccaaaagtttccagaaacaccctgtatttctcatagatttgaaaattattgatccagtttcagaagataagtgttaattttcttttgcagaaaaatgtaaggggtgaattcacttattatgaaatacaagataatacagggaagatggaagtggtggtgcatggacgactgaccacaatcaactgtgaggaaggagataaactgaaactcacctgctttgaattggcaccgaaaagtgggaataccggggagttgagatctgtaattcatagtcacatcaaggtcatcaagaccaggaaaaacaagaaagacatactcaatcctgattccaagtatggaaacttcaccagactttttcttctaaaatctggatgtcattgacgataatgtttatggagataaggtctaagtgcctaaaaaaatgtacatatacctggttgaaatacaacactatacatacacaccaccatatatactagctgttaatcctatggaatggggtattgggagtgcttttttaatttttcatagtttttttttaataaaatggcatattttgcatctacaacttctataatttgaaaaaataaataaacattatcttttttgtgaaaaaaaaa

SEQ ID NO: 18 - DNA, 5942 bp, Homo sapiens
ccgggtccttctccgagagccgggcgggcacgcgtcattgtgttacctgcggccggcccgcgagctaggctggttttttttttttctcccctccctcccccctttttccatgcagctgatctaaaagggaataaaaggctgcgcataatcataataataaaagaaggggagcgcgagagaaggaaagaaagccgggaggtggaagaggagggggagcgtctcaaagaagcgatcagaataataaaaggaggccgggctctttgccttctggaacgggccgctcttgaaagggcttttgaaaagtggtgttgttttccagtcgtgcatgctccaatcggcggagtatattagagccgggacgcggcggccgcaggggcagcggcgacggcagcaccggcggcagcaccagcgcgaacagcagcggcggcgtcccgagtgcccgcggcgcgcggcgcagcgatgcgttccccacggacgcgcggccggtccgggcgccccctaagcctcctgctcgccctgctctgtgccctgcgagccaaggtgtgtggggcctcgggtcagttcgagttggagatcctgtccatgcagaacgtgaacggggagctgcagaacgggaactgctgcggcggcgcccggaacccgggagaccgcaagtgcacccgcgacgagtgtgacacatacttcaaagtgtgcctcaaggagtatcagtcccgcgtcacggccggggggccctgcagcttcggctcagggtccacgcctgtcatcgggggcaacaccttcaacctcaaggccagccgcggcaacgaccgcaaccgcatcgtgctgcctttcagtttcgcctggccgaggtcctatacgttgcttgtggaggcgtgggattccagtaatgacaccgttcaacctgacagtattattgaaaaggcttctcactcgggcatgatcaaccccagccggcagtggcagacgctgaagcagaacacgggcgttgcccactttgagtatcagatccgcgtgacctgtgatgactactactatggctttggctgcaataagttctgccgccccagagatgacttctttggacactatgcctgtgaccagaatggcaacaaaacttgcatggaaggctggatgggccgcgaatgtaacagagctatttgccgacaaggctgcagtcctaagcatgggtcttgcaaactcccaggtgactgcaggtgccagtacggctggcaaggcctgtactgtgataagtgcatcccacacccgggatgcgtccacggcatctgtaatgagccctggcagtgcctctgtgagaccaactggggcggccagctctgtgacaaagatctcaattactgtgggactcatcagccgtgtctcaacgggggaacttgtagcaacacaggccctgacaaatatcagtgttcctgccctgaggggtattcaggacccaactgtgaaattgctgagcacgcctgcctctctgatccctgtcacaacagaggcagctgtaaggagacctccctgggctttgagtgtgagtgttccccaggctggaccggccccacatgctctacaaacattgatgactgttctcctaataactgttcccacgggggcacctgccaggacctggttaacggatttaagtgtgtgtgccccccacagtggactgggaaaacgtgccagttagatgcaaatgaatgtgaggccaaaccttgtgtaaacgccaaatcctgtaagaatctcattgccagctactactgcgactgtcttcccggctggatgggtcagaattgtgacataaatattaatgactgccttggccagtgtcagaatgacgcctcctgtcgggatttggttaatggttatcgctgtatctgtccacctggctatgcaggcgatcactgtgagagagacatcgatgaatgtgccagcaacccctgtttggatgggggtcactgtcagaatgaaatcaacagattccagtgtctgtgtcccactggtttctctggaaacctctgtcagctggacatcgattattgtgagcctaatccctgccagaacggtgcccagtgctacaaccgtgccagtgactatttctgcaagtgccccgaggactatgagggcaagaactgctcacacctgaaagaccactgccgcacgaccccctgtgaagtgattgacagctgcacagtggccatggcttccaacgacacacctgaaggggtgcggtatatttcctccaacgtctgtggtcctcacgggaagtgcaagagtcagtcgggaggcaaattcacctgtgactgtaacaaaggcttcacgggaacatactgccatgaaaatattaatgactgtgagagcaacccttgtagaaacggtggcacttgcatcgatggtgtcaactcctacaagtgcatctgtagtgacggctgggagggggcctactgtgaaaccaatattaatgactgcagccagaacccctgccacaatgggggcacgtgtcgcgacctggtcaatgacttctactgtgactgtaaaaatgggtggaaaggaaagacctgccactcacgtgacagtcagtgtgatgaggccacgtgcaacaacggtggcacctgctatgatgagggggatgcttttaagtgcatgtgtcctggcggctgggaaggaacaacctgtaacatagcccgaaacagtagctgcctgcccaacccctgccataatgggggcacatgtgtggtcaacggcgagtcctttacgtgcgtctgcaaggaaggctgggaggggcccatctgtgctcagaataccaatgactgcagccctcatccctgttacaacagcggcacctgtgtggatggagacaactggtaccggtgcgaatgtgccccgggttttgctgggcccgactgcagaataaacatcaatgaatgccagtcttcaccttgtgcctttggagcgacctgtgtggatgagatcaatggctaccggtgtgtctgccctccagggcacagtggtgccaagtgccaggaagtttcagggagaccttgcatcaccatggggagtgtgataccagatggggccaaatgggatgatgactgtaatacctgccagtgcctgaatggacggatcgcctgctcaaaggtctggtgtggccctcgaccttgcctgctccacaaagggcacagcgagtgccccagcgggcagagctgcatccccatcctggacgaccagtgcttcgtccacccctgcactggtgtgggcgagtgtcggtcttccagtctccagccggtgaagacaaagtgcacctctgactcctattaccaggataactgtgcgaacatcacatttacctttaacaaggagatgatgtcaccaggtcttactacggagcacatttgcagtgaattgaggaatttgaatattttgaagaatgtttccgctgaatattcaatctacatcgcttgcgagccttccccttcagcgaacaatgaaatacatgtggccatttctgctgaagatatacgggatgatgggaacccgatcaaggaaatcactgacaaaataattgatcttgttagtaaacgtgatggaaacagctcgctgattgctgccgttgcagaagtaagagttcagaggcggcctctgaagaacagaacagatttccttgttcccttgctgagctctgtcttaactgtggcttggatctgttgcttggtgacggccttctactggtgcctgcggaagcggcggaagccgggcagccacacacactcagcctctgaggacaacaccaccaacaacgtgcgggagcagctgaaccagatcaaaaaccccattgagaaacatggggccaacacggtccccatcaaggattacgagaacaagaactccaaaatgtctaaaataaggacacacaattctgaagtagaagaggacgacatggacaaacaccagcagaaagcccggtttgccaagcagccggcgtatacgctggtagacagagaagagaagccccccaacggcacgccgacaaaacacccaaactggacaaacaaacaggacaacagagacttggaaagtgcccagagcttaaaccgaatggagtacatcgtatagcagaccgcgggcactgccgccgctaggtagagtctgagggcttgtagttctttaaactgtcgtgtcatactcgagtctgaggccgttgctgacttagaatccctgtgttaatttaagttttgacaagctggcttacactggcaatggtagtttctgtggttggctgggaaatcgagtgccgcatctcacagctatgcaaaaagctagtcaacagtaccctggttgtgtgtccccttgcagccgacacggtctcggatcaggctcccaggagcctgcccagccccctggtctttgagctcccacttctgccagatgtcctaatggtgatgcagtcttagatcatagttttatttatatttattgactcttgagttgtttttgtatattggttttatgatgacgtacaagtagttctgtatttgaaagtgcctttgcagctcagaaccacagcaacgatcacaaatgactttattatttatttttttaattgtatttttgttgttgggggaggggagactttgatgtcagcagttgctggtaaaatgaagaatttaaagaaaaaaatgtcaaaagtagaactttgtatagttatgtaaataattcttttttattaatcactgtgtatatttgatttattaacttaataatcaagagccttaaaacatcattcctttttatttatatgtatgtgtttagaattgaaggtttttgatagcattgtaagcgtatggctttatttttttgaactcttctcattacttgttgcctataagccaaaattaaggtgtttgaaaatagtttattttaaaacaataggatgggcttctgtgcccagaatactgatggaattttttttgtacgacgtcagatgtttaaaacaccttctatagcatcacttaaaacacgttttaaggactgactgaggcagtttgaggattagtttagaacaggtttttttgtttgtttgttttttgtttttctgctttagacttgaaaagagacaggcaggtgatctgctgcagagcagtaagggaacaagttgagctatgacttaacatagccaaaatgtgagtggttgaatatgattaaaaatatcaaattaattgtgtgaacttggaagcacaccaatctgactttgtaaattctgatttcttttcaccattcgtacataatactgaaccacttgtagatttgattttttttttaatctactgcatttagggagtattctaataagctagttgaatacttgaaccataaaatgtccagtaagatcactgtttagatttgccatagagtacactgcctgccttaagtgaggaaatcaaagtgctattacgaagttcaagatcaaaaaggcttataaaacagagtaatcttgttggttcaccattgagaccgtgaagatactttgtattgtcctattagtgttatatgaacatacaaatgcatctttgatgtgttgttcttggcaataaattttgaaaagtaatatttattaaatttttttgtatgaaaacatggaacagtgtggctcttctgagcttacgtagttctaccggctttgccgtgtgcttctgccaccctgctgagtctgttctggtaatcggggtataataggctctgcctgacagagggatggaggaagaactgaaaggcttttcaaccacaaaactcatctggagttctcaaagacctggggctgctgtgaagctggaactgcgggagccccatctaggggagccttgattcccttgttattcaacagcaagtgtgaatactgcttgaataaacaccactggattaatggaaaaaaaaaaaaaaaa

SEQ ID NO: 19 - DNA, 1471 bp, Homo sapiens
ggcacgaggctaagccataatagaaagaatggagaattattgattgaccgtctttattctgtgggctctgattctccaatgggaataccaagggatggttttccatactggaacccaaaggtaaagacactcaaggacagacatttttggcagagcatagatgaaaatggcaagttccctggctttccttctgctcaactttcatgtctccctcctcttggtccagctgctcactccttgctcagctcagttttctgtgcttggaccctctgggcccatcctggccatggtgggtgaagacgctgatctgccctgtcacctgttcccgaccatgagtgcagagaccatggagctgaagtgggtaagttccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctctgacagtggaaagtacttgtgttatttccaagatggtgacttctatgaaaaagccctggtggagctgaaggttgcagcactgggttctaatcttcacgtcgaagtgaagggttatgaggatggagggatccatctggagtgcaggtccaccggctggtacccccaaccccaaatacagtggagcaacgccaagggagagaacatcccagctgtggaagcacctgtggttgcagatggagtgggcctatatgaagtagcagcatctgtgatcatgagaggcggctccggggagggtgtatcctgcatcatcagaaattccctcctcggcctggaaaagacagccagcatttccatcgcagaccccttcttcaggagcgcccagccctggatcgcagccctggcagggaccctgcctatcttgctgctgcttctcgccggagccagttacttcttgtggagacaacagaaggaaataactgctctgtccagtgagatagaaagtgagcaagagatgaaagaaatgggatatgctgcaacagagcgggaaataagcctaagagagagcctccaggaggaactcaagaggaaaaaaatccagtacttgactcgtggagaggagtcttcgtccgataccaataagtcagcctgatgctctaatggaaaaatggccctcttcaagcctggtgaggaaatgcttcagatgaggctccaccttgttaaataaattggatgtatggaaaaatagactgcagaaaaggggaactcatttagctcacgagtggtcgagtgaagattgaaaattaacctctgagggccagcacagcagctcatgcctgtaatcctagcactttggaaggctgaggagggcggatcacaaggtcaggagatcaagaccatcctggctaacacggtgaaaccccgtctctactaaaaatacaaaaaaaaaaaaaaaaaa

SEQ ID NO: 20 - DNA, 2937 bp, Homo sapiens
acgcgtccgcttcggaatgagagactcaaccataatagaaagaatggagaactattaaccaccattcttcagtgggctgtgattttcagaggggaatactaagaaatggttttccatactggaacccaaaggtaaagacactcaaggacagacatttttggcagagcatagatgaaaatggcaagttccctggctttccttctgctcaactttcatgtctccctcttcttggtccagctgctcactccttgctcagctcagttttctgtgcttggaccctctgggcccatcctggccatggtgggtgaagacgctgatctgccctgtcacctgttcccgaccatgagtgcagagaccatggagctgaggtgggtgagttccagcctaaggcaggtggtgaacgtgtatgcagatggaaaggaagtggaagacaggcagagtgcaccatatcgagggagaacttcgattctgcgggatggcatcactgcagggaaggctgctctccgaatacacaacgtcacagcctctgacagtggaaagtacttgtgttatttccaagatggtgacttctacgaaaaagccctggtggagctgaaggttgcagcattgggttctgatcttcacattgaagtgaagggttatgaggatggagggatccatctggagtgcaggtccactggctggtacccccaaccccaaataaagtggagcgacaccaagggagagaacatcccggctgtggaagcacctgtggttgcagatggagtgggcctgtatgcagtagcagcatctgtgatcatgagaggcagctctggtgggggtgtatcctgcatcatcagaaattccctcctcggcctggaaaagacagccagcatatccatcgcagaccccttcttcaggagcgcccagccctggatcgcggccctggcagggaccctgcctatctcgttgctgcttctcgcaggagccagttacttcttgtggagacaacagaaggaaaaaattgctctgtccagggagacagaaagagagcgagagatgaaagaaatgggatacgctgcaacagagcaagaaataagcctaagagagaagctccaggaggaactcaagtggaggaaaatccagtacatggctcgtggagagaagtctttggcctatcatgaatggaaaatggccctcttcaaacctgcggatgtgattctggatccagacacggcaaacgccatcctccttgtttctgaggaccagaggagtgtgcagcgtgctgaagagccgcgggatctgccagacaaccctgagagatttgaatggcgttactgtgtccttggctgtgaaaacttcacatcagggagacattactgggaggtggaagtgggggacagaaaagagtggcatattggggtatgtagtaagaacgtggagaggaaaaaaggttgggtcaaaatgacaccggagaacggatactggactatgggcctgactgatgggaataagtatcgggctctcactgagcccagaaccaacctgaaacttcctgagcctcctaggaaagtggggatcttcctggactatgagactggagagatctcgttctataatgccacagatggatctcatatctacacctttccgcacgcctctttctctgagcctctatatcctgttttcagaattttgaccttggagcccactgccctgaccatttgcccaataccaaaagaagtagagagttcccccgatcctgacctagtgcctgatcattccctggagacaccactgaccccgggcttagctaatgaaagtggggagcctcaggctgaagtaacatctctgcttctccctgcccaccctggagctgaggtctccccttctgcaacaaccaatcagaaccataagctacaggcacgcactgaagcactttactgatattcattccattattccatatgacagttgttttgagtttcgtaccaccttattgtccccttatacagataaggaaactggggtgcagaaaggtgaattaactttacaaagtagacatgacaagtgaacagcagagctgggatctaaacagcaataactaacattaacagagaatttaaaatgttcttagtgctgtgttataagctttggtggatgtcactcctttaatcctcacaacaccctgtcgggtagtcatattttgcaagtatggaagctgaggcagggcaacatgaagtaacttacataattcatacagtaatttgtgcagttgggagatgttcagccttagtccctggctaattgcctgttcttttccagcctgattttttttcccacaggaagagcccacatgtagccctgaggtttccttcccaggacagctgcagggtagagatcattttaagtgcttgtggagttgacatccctattgactctttcccagctgatatcagagacttagacccagcactccttggattagctctgcagagtgtcttggttgagagaataacctcatagtaccaacatgacatgtgacttggaaagagactagaggccacacttgataaatcatggggcacagatatgttcccacccaacaaatgtgataagtgattgtgcagccagagccagccttccttcaatcaaggtttccaggcagagcaaataccctagagattctctgtgatataggaaatttggatcaaggaagctaaaagaattacagggatgtttttaatcccactatggactcagtctcctggaaataggtctgtccactcctggtcattggtggatgttaaacccatattcctttcaactgctgcctgctagggaaaactgctcctcattatcatcactattattgctcaccactgtatcccctctacttggcaagtggttgtcaagttctagttgttcaataaatgtgttaataatgaaaaaaaaaaa

SEQ ID NO: 21 - DNA, 2290 bp, Homo sapiens
agaacatagggtactccgagtgaagaattcagcagctaagtggaagttgtcttctattccactttaaatacttttatctactgaatcgcaagaaaattgggtttctggtgctgtctgtggttcatgagaaaaaatcccaagaaggaaagccaaaagaacacacagagccaaaaagcctacccaagcaggcatcagatacaggaagtaacgatgctcacaataaaaaagcagtttccagatcagctgaacagcagccatcagagaaatcaacagaaccaaagactaaaccacaagacatgatttctgctggtggagagagtgttgctggtatcactgcaatatctggcaagccgggtgacaagaaaaaagaaaagaaatcattaaccccagctgtgccagttgaatctaaaccggataaaccatcgggaaagtcaggcatggatgctgctttggatgacttaatagatactttaggaggacctgaagaaactgaagaagaaaatacaacgtatactggaccagaagtttcagatccaatgagttccacctacatagaggaattgggtaaaagagaagtcacaattcctccaaaatatagggaactattggctaaacccatagggccagatgatgctatagacgccttgtcatctgacttcacctgtgggtcgcctacagctgctggaaagaaaactgaaaaagaggaatctacagaagttttaaaagctcagtcagcagggacagtcagaagtgctgctccaccccaagagaagaaaagaaaggtggagaaggatacaatgagtgatcaagcactcgaggctctgtcggcttcactgggcacccggcaagcagaacctgagctcgacctccgctcaattaaggaagtcgatgaggcaaaagctaaagaagaaaaactagagaagtgtggtgaggatgatgaaacaatcccatctgagtacagattaaaaccagccacggataaagatggaaaaccactattgccagagcctgaagaaaaacccaagcctcggagtgaatcagaactcattgatgaactttcagaagattttgaccggtctgaatgtaaagagaaaccatctaagccaactgaaaagacagaagaatctaaggccgctgctccagctcctgtgtcggaggctgtgtgtcggacctccatgtgtagtatacagtcagcaccccctgagccggctaccttgaagggcacagtgccagatgatgctgtagaagccttggctgatagcctggggaaaaaggaagcagatccagaagatggaaaacctgtgatggataaagtcaaggagaaggccaaagaagaagaccgtgaaaagcttggtgaaaaagaagaaacaattcctcctgattatagattagaagaggtcaaggataaagatggaaagccactcctgccaaaagagtctaaggaacagcttccacccatgagtgaagacttccttctggatgctttgtctgaggacttctctggtccacaaaatgcttcatctcttaaatttgaagatgctaaacttgctgctgccatctctgaagtggtttcccaaaccccagcttcaacgacccaagctggagccccaccccgtgatacctcgcagagtgacaaagacctcgatgatgccttggataaactctctgacagtctaggacaaaggcagcctgacccagatgagaacaaaccaatggaagataaagtaaaggaaaaagctaaagctgaacatagagacaagcttggagaaagagatgacactatcccacctgaatacagacatctcctggatgataatggacaggacaaaccagtgaagccacctacaaagaaatcagaggattcaaagaaacctgcagatgaccaagaccccattgatgctctctcaggagatctggacagctgtccctccactacagaaacctcacagaacacagcaaaggataagtgcaagaaggctgcttccagctccaaagcacctaagaatggaggtaaagcgaaggattcagcaaagacaacagaggaaacttccaagccaaaagatgactaaagaaatacaagttaaggtatctggtatctgcatgtaaaatcttcagctggtggatggtgacttttgaagaacaaaaggctttggcaacagaaaacaattgttctgggtgatttctagaatggtttttgttgagtctctgaacatcctaaatattggtttgttattcttttccagaaagaaaatgaatttgactggttcacctgccaaaaaaaaaaaaaaaa

SEQ ID NO: 22 - DNA, 2544 bp, Homo sapiens
caccgggcagcgccgagggttgccggccggcgcgcggggagtagagggcgcgggccgcagtgccgggttccagagggagctctgcgccgggtccttccctgtggtagccccaggacacccccagcctcaacatcccattctgggactcctgccctgttcccacattcgttctacctcgagtctccaggagcttccagtggcttggtcaccgccaactctcgtccatgcctcttagagcccctttcccggcctcaccgggtgtcgcttaatagtcttgggaccttaaggagcaagtcagcccctgcggaccctcccagtgaagagaaagagctggctgtgcggtggaatttggaagagacgacgtttgggagcctttgctgagtccagggagagaggcgtcccccaccgtgccgctgcagctcgggcagagccgccaagctttgggttctctagggtgtgtacccaggagtggatctgctgtatcatatggtcactctattcaacctttcgagaaaccaccaaattgtttcttcaggaaatgcaccatctgacatccccattttatgaggatccccacgtctctgtcatctcaccaacacttgtgctgaggaacctctaatcatctcccatggatttgtgatcagcgttgcagctctcccagcagccctggacagtggcccccagcagtcagcatgtggctgccgcgcgtctccagcacagcagtgaccgcgctcctcctggcgcagaccttcctcctcctctttctggtttcccggccagggccctcgtccccagcaggcggcgaggcgcgcgtgcatgtgctggtgctgtcctcgtggcgctcgggctcgtccttcgtgggccaactcttcaaccagcaccccgacgtcttctacctaatggagcccgcgtggcacgtgtggaccaccctgtcgcagggcagcgccgcaacgctgcacatggctgtgcgcgacctggtgcgctccgtcttcctgtgcgacatggacgtgtttgatgcctatctgccttggcgccgcaacctgtccgacctcttccagtgggccgtgagccgtgcactgtgctcgccacccgcctgcagtgcctttccccgaggcgccatcagcagcgaggccgtgtgcaagccactgtgcgcgcggcagtccttcaccctggcccgggaggcctgccgctcctacagccacgtggtgctcaaggaggtgcgcttcttcaacctgcaggtgctctacccgctgctcagcgaccccgcgctcaacctacgcatcgtgcacctggtgcgcgacccgcgggccgtgctgcgctcccgggagcagacagccaaggctctggcgcgtgacaacggcatcgtgctgggcaccaacggcacgtgggtggaggccgaccccggcctgcgcgtggtgcgcgaggtgtgccgtagccacgtacgcatcgccgaggccgccacactcaagccgccaccctttctgcgcggccgctaccgcctggtgcgcttcgaggacctggcgcgggagccgctggcagaaatccgtgcgctctacgccttcactgggctcagtctcacgccacagctcgaggcctggatccataacatcacccacggatctggacctggtgcgcgccgcgaagccttcaagacttcgtccaggaatgcgctcaacgtctcccaggcctggcgccatgcgctgccctttgccaagatccgccgcgtgcaggaactgtgcgctggtgcgctgcagctgctgggctaccggcctgtgtactctgaggacgagcagcgcaacctcgcccttgatctggtgctgccacgaggcctgaacggcttcacttgggcatcatccaccgcctcgcacccccgaaattagtggaggccacagttgtagcaggcgctaggcccgggaggagagtgcatggtgcagagggggctggggcgcacggagaagcaggtccctatattgaccaaggagtttgtggtacgacccctccccctccccaagtaggcaaggactgcacgtttctttctctcttgattcttggttttcctttgagtcctcatttcagggttcacttcaggggctcccaaagcgacaagatcgttagggagagaggcccagggtggggactgggaatttaaggagagctgggaacggatcccttaggttcaggaagcttctgtgcaagctgcgaggatggcttgggccgaagggttgctctgcccgccgcgctagctgtgagctgagcaaagccctgggctcacagcaccccaaaagcctgtggcttcagtcctgcgtctgcaccacccaatcaaaaggatcgttttgttttgtttttaaagaaaggtgagattggcttggttcttcatgagcacatttgatatagctctttttctgtttttccttgctcatttcgttttggggaagaaatctgtactgtattgggattgtaaagaacatctttgcactcagacagtttacagaaataaatgttttttttgtttttcaaaaaaaaaaaaaaaaaaaaaaaaaaaaa

SEQ ID NO: 23 - DNA, 941 bp, Homo sapiens
catctgtgaagaaagtggccctttctcccgcttgcaaaatagacattctcaaattccaaaatgccagccaagaccccaatttacctgaaagcagccaataacaagaaaggaaagaaatttaaactgagggacattctgtctcctgatatgatcagtcccccgcttggagactttcgccacaccatccacattggcaaagagggccagcacgatgtctttggagataattcctttcttcaagggaactacgagcttttacctggaaaccaggagaaagcacacctgggccagttccctgggcataatgagttcttccgggccaacagcacctcggactctgtgttcacagaaacgccctccccggtgctcaaaaatgccatctccctcccgaccattggaggatcccaagctctcatgttgcccttattgtcaccagtgacatttaattccaaacaggagtccttcgggccagcaaagctgcccaggcttagctgcgagcccgtcatggaggaaaaagctcaggagaaaagcagtctgttggagaatgggacagtccaccagggagacacctcgtggggctccagcggttctgcatctcagtccagccaaggcagagacagccactcctccagcctgtccgaacagtaccccgactggccagccgaggacatgtttgaccatcccaccccatgcgagctcatcaagggaaagactaagtcagaggagtccctctctgaccttacaggttccctcctctccctgcagcttgatcttgggccctcacttttggatgaggtgctgaatgtaatggataaaaataagtaacaagatgccaacttttttcctttggggtaaaaggtacaaaaacaaactaaccacagttgaagagaagggcttccggagctgtattttgcaattttgtgttgggttttctaaaataa

SEQ ID NO: 24 - DNA, 4333 bp, Homo sapiens
cgcagagcgcgcacccaagcggccggacctccccgactcccgggccgcccccgtctcgcgccctgcctccctccttcggccttcacctacccgcctccggattggccgctaggaatcccgcccctctaaagccctgcctgctattggtcacgattttataatcaatggataaagtgggaaaaatgtggaataacttcaaatacaggtgtcagaatctcttcggtcatgagggaggaagccgtagtgaaaatgtggacatgaactccaacagatgtttgtctgtcaaagagaaaaacatcagcataggagactcaactcctcagcaacaaagcagtcccttaagagaaaatattgccttacaactgggattaagcccttcgaagaattcttcaaggagaaatcaaaattgtgccacagaaatccctcaaattgttgaaataagcatcgaaaaggataatgattcttgtgttaccccaggaacaagacttgcacgaagagattcctactctcgacatgctccatggggtgggaagaaaaaacattcctgttctacaaagacccagagttcattggatgctgataaaaagtttggtagaactcgaagtggacttcaaaggagagagaggcgctacggcgtaagttctgtacacgacatggacagtgtttccagcagaactgtaggaagtcgctctctaagacagaggttgcaggatactgtgggcttgtgttttcccatgagaacttacagcaagcagtcaaagcctctcttttccaataaaagaaaaatccatctctctgaattaatgcttgagaaatgcccttttcctgctggctcagatttagcccaaaaatggcatttgattaaacagcatacagctcctgtgagcccacattcaacattttttgatacatttgatccatctttggtttctacagaagatgaagaagataggcttagagagagaaggcggcttagtattgaagaaggggttgatccccctcccaatgcacaaatacatacatttgaagctactgcacaggttaatccattatataaactgggaccaaaattagctcctggaatgactgaaataagtggggacagttctgcaattccacaagctaattgtgactcggaagaggatacaaccaccctgtgtttgcagtcacggaggcagaagcagcgtcagatatctggagacagccatacccatgttagcagacagggagcttggaaagtccacacacagattgattacatacactgcctcgtgcctgatttgcttcaaattacagggaatccctgttactggggagtgatggaccgttatgaagcagaagcccttctcgaagggaaacctgaaggcacgtttttgctcagggactctgcgcaagaggactacctcttctctgtgagcttccgccgctacaacagatccctgcatgcccgaattgagcagtggaatcacaactttagtttcgacgcccatgacccgtgtgtatttcactcctccactgtaacgggacttttagaacattataaagatcccagttcgtgcatgttttttgaaccattgcttactatatcactaaataggactttcccttttagcctgcagtatatctgtcgcgcggtaatctgcaggtgcactacgtatgatggaattgatgggctccctctaccctcaatgttacaggattttttaaaagagtatcattataaacaaaaagttagagttcgctggttggaacgagaaccagtcaaggcaaagtaaactctccggtccccaaaggttgttaactaggtccgctttcatgtgcatcagacagtacacctatagcaagcacacgtagcagtgttaggctttttcatacagtatgtaagcttagtgttagtatctgtcagatgctacctgctgttacttattcagataaacatggtgcctattggaacaatagcggatagagctacaggtgttcagtaagactacaaaaacattttgcctatttcgctaacagtttggtttttaatggctgtggtatttgagtgaggcaactctggggcatttgttatgaagaattctatttcttactgaagaacaaattattaatattggatgagtatttcaacagtgtgactaatgtttgaaattattttttctaagagtttttctataaccttccaaaagtcgtgatgtttgtagttactataaatcaagctttggaagtccaaaaagaataaaagactgccttccttttagaaaaaaatgcaattttctggccacaagggcatagtgcagttcacttacgtgttgatgtagtttataatcagacgccttttctcttctgcaaaaggtactgttaagtaaaccagattttctaaataggcattcttaaaatttcagacttacaaagctagtagtagaattttattgaaaggcctaggtattaattttttaaatgagtgctttaacttaaaacaggcgtttggaatagctgctgcaatgtagtcttgtgtgtgatttttttttaagttgatgtgcagtctaattgttgtttcataaaagttggatctgttcctatgcccaggatgattttgtgaaccgtgaagtacgtgagactagaagacgcccaaacaagtcagataatagtaactacaatggttgctgatgttgagattattgttgaactataattaataatttggatggcagaatttatctcttttttgtaaactctcataactgaattgcttaagtataatttatagaatttcagtgcagttcattcttaatggaaaatctgaaacctaaattgcagatttaaaaggtactgtacaaccattatatctgtaaataacttagcacctttttgtcacttagaataatatgtactactacttgagtgagcgcttttggaagttatatcaagttctagtgtttgcttcttagtaactgaactgaatttacagttctgtcctagacattttgcactaaagtagccgaatccactctcatgtcttttcgttaatgtgctctgtaccactggtgagtgctccatagtttccttacctgctgctacagaatgttattttacatccctatggctattgccaaggctacaaaaaaggaaagctatatttgtatgcaacactaaccttttgactgctaatgtatgtttctgcttgctgtgccttgttatggctgctttttttgtgctaataaagtatgtttggtgttctccttgtatatctgctgttttatacatttgcaacaatttctcttgtaaatggaatggtttggggtttttaaataagcattaactaacaacctttctatagttaatgcagagttaatgaacagtctaatattgacttatcagaataagctaactctaaatttaatgctctacatcttatcagtcataattatatatactgtggaacagtatctgtagttactgcaaattactgtacagtttaggttataacagaaaactgacagagaagtaataaacctattgatttctctgcttataaatgaaagattgaaactatccaatgacatattatagtaaatgagtatctgtaacctcccactgcatcagaagcaggttaaatgaagtcttgtgaatttgtaatagatcagtaccatttattggtttggggaccatcttaattaaaaataaatgcccaaaatgtagaactttaaccaaagacttgtcccttttaaagcaaaatggggattgaagggacttataatttctgttgtttctaattaaagtccctgaagatcatataccaaagtgtttgagaacttcatccaaacctactttaaagcattatgtgcaattaagttgttatgacataattatattgcctaattgttgggtcttttttcttgagcttataatgtacctggaaaataaacctcttgagaaaaagaaaagttcatactgattattggaaaaggactatatatgtgagcaagattgtgttttagagaggaaacttgaaactccaagaaagcacttgatgtttttatatgcttgtagcaaattgatgttctaactgtagttttatagaaagtattaatgcttttatgtatttcaaaactttcatatgttaaatggaaattgttttaaatgtgtttgagtttatgtaagcatgtatacactgtgctaaaagtcacatgtttcagtttgtgtataatattaatatgcaatttttggtttaaatttttgtcttaaaatattagtggcttacattttaaaaaagaaaaatcaccagcatgaacttgcaaaaaaaaaaaaaaaaaaaaaaaaaaaaaaaaaa

SEQ ID NO: 25 - DNA, 1042 bp, Homo sapiens
vtttatttctgtaaactgtctgagtgcagagatgttctttacaatcccaatacagtacagatttcttccccaaaacgaaatgagcaaggaaaaacagaaaaagagctatatcaaatgtgctcatgaagaaccaagccaatctcacctttctttaaaaacaaaacaaaacgttccttttgaatgtgtggtgcagacgcaggactgamgccacaggcttttggggtgctgtgmgcccagggctttgctcagctcacagctagcscsgcgggcmgagcmacccttcggcccaagccatcctcgcagcttgcmcagaagcttcctgaacctaagggatccgttcccagctctccttaaattcccagtccccaccctgggcctctctccctaacgttcttgtcgctttgggggcccctgaagtgaaccctgaaatactccctccgtcaactctgggctcagacctttgcccttctctgtgtcacaaggaaatttcggtcaagagggtgggaacgggtggtttcagaccgtgcagcaaagccactgccaggtaagttttarggcaaattttatctcttcttattcagtctgagccggacctaaccttctcaccaccgggcaatcctgcctatgctgggcatgcatcttgggcaactccggatggaggtgggatgagggagcccggggcggataccaggaggtctgggccttagtagggaatggacgtgtgtgcttatgaaggctgcaggcaccgggcacagctcctggcccagctgcccctcagtggtacmaggaagcagggcccaggaaaactgagatggcaakataggcccgggctctggaaagcaacgtgaggtcatgcagatctcactaggcagacctcgtcgcgtggaagagaaatgccaggaaaaggggtcactgcaggaggcacctcggatctgatggcaggcaggacttgcatcaaaatgacttttctttagaacaaaaagagggggagaaaagaaaagagatcaaagaagaggtccatgagcgyctgagataggcgcgg

SEQ ID NO: 26 - DNA, 501 bp, Homo sapiens
tttttttggttgtggtattgatttatttttccccagcacatcttaaaaatcacacatgggcatttgcttatagaacaatacagtctaagaaaaccagtaagaggagaatctgaacacacactgaaagcacggaatactgactatgtgttgagcccttgtggaaaacagtatggctcagtcggaattgacaaagctatgctggaatctctcaggaattttccttcccactgcatatccccttttagactataaatgtaaagagaagaattgtttgtatgcattagttacagcagtataatggcttacatacaagtgcttactcacatgtagttcccaaaggattactacagtcctggcaggaatatgtactgccttggaggaagactcaggataagatattattcaagttaagttgtatcagagccaaagtatttcacaggcttagcaaaaatggacaagaattaatataacctacatatatttctcataagatttaatcat

SEQ ID NO: 27 - DNA, 1635 bp, Homo sapiens
attttcgagttggtgagacaccgcggcagtcgacttggaagatgctctggtggtagaggtggacttagtagttttaagcagaaccatgaaaacctctgtgacaactccctccagctccaagagtgccgggaggtggggggcggcgcatccgcggcctcgagcttgctacctcagcccatccccaccacccctgacatcgagaacgctgagctcacccccatcttgcccttcctgttccttggcaatgagcaggatgctcaggacctggacaccatgcagcggctgaacatcggctacgtcatcaacgtcaccactcatcttcccctctaccactatgagaaaggcctgttcaactacaagcggctgccagccactgacagcaacaagcagaacctgcggcagtactttgaagaggcttttgagttcattgaggaagctcaccagtgtgggaaggggcttctcatccactgccaggctggggtgtcccgctccgccaccatcgtcatcgcttacttgatgaagcacactcggatgaccatgactgatgcttataaatttgtcaaaggcaaacgaccaattatctccccaaaccttaacttcatggggcagttgctagagttcgaggaagacctaaacaacggtgtgacaccgagaatccttacaccaaagctgatgggcgtggagacggttgtgtgacaatggtctggatggaaaggattgctgctctccattaggagacaatgaggaaggaggatggattctggttttttttctttcttttttttttgtagttgggagtaagtttgtgaatggaaacaaacttgtttaaacactttatttttaacaagtgtaagaagactataacttttgatgccattgagattcacctcccacaaactgacaaattaaggaggttaaagaagtaatttttttaagccaacaataaaaatataatacaacttgtttctcccccttttccttttaagctatttgtagagtttatgactaaatagtctgtgcaggttcatagaccgaagatactacacactttaaaccaattaaaaagaaccaaaagtaaatagaaaagacattgaatcaccaaggcctgggatcaacctgggctgtccacacagaaaacaaaaacccaaccaaaccaagccctgttgtgctcactggtgcaaagagaagatcagggcagcttaagtggtctaagaatccttcaggcattctttaaggagaaaaaggatacctttgattttgtgtgtttcatgctctggattttttttttttccttctctgggtttaagagattttttttgaaatagtgaggaactgaccattatatgccttcactggcttcttgtgcaataatatgatgttttaagtgtgcaaacaagttagagctggcagctgaatgatagacaaatagtgcaaatttgccagcttggagatagaaaggaattcaacaatatatcaaatactttccttcccacctttttccttttttttttttttttctgatttgattctggttacagtgccataaaccttgttacatatgtatatcagaatgtaagaaaaaaaaatttatttaaaaatatttttcgcagaaaaaaaaaaaaaaaaaaaaaaaaa

SEQ ID NO: 28 - DNA, 593 bp, Homo sapiens
tttttttttttttttttaacacaaagtttttattgaacaaaaataatatgacagtaaaaatgatacataaagtgaagatttgcagtcatagaaaagatgtgtacaaagagaccaacattcaggttatatagttctataaaacttttcccatagcagtttaacactgattaagcagacataaaagggaaaagaaagtcattaatgttctttgaaacctattttctgagtaaaatacctctgctaacacacacatgcacacacacacagaatgaggcagagctatatgagtgagttattcttcagttcctccagttctctgtttgtgttacaggagtattttcatccatcaaaaaattgtagtatttttgcatttctaataaatggatctagagcatacattaatcccagtttccaaaggaaaagaaagaatcagatctatagtcatttaaatatttccaatcagcatttacgtaaacaagtatactaaaaatagtagttttggttgagatttttgcacattaacttcctttagtttgtaagaatcatgcattttggatgtgttctcttatctgacaacacagttttaaatgctg

SEQ ID NO: 29 - DNA, 2687 bp, Homo sapiens
acggcgcgctgggctcacactgtcccgccgcggacgggctttgtggttgggggcgcgcgtgcgagtgccagtgagagtgtgggtgcgcgctgtgggccgcggcgcgggtgggtggccgtgcgttcttgcgagccggcctgcaggaggcgaggctcccctggcctcccgcacccagcggcggaccgagcccctggagggaagttgccgcagccgcccgggccgccggccctcctgtcccgcgccaggtacacagcttctcctagcatgacttcgatctgatcagcaaacaagaaaatttgtctcccgtagttctggggcgtgttcaccacctacaaccacagagctgtcatggctgccatctctacttccatccctgtaatttcacagccccagttcacagccatgaatgaaccacagtgcttctacaacgagtccattgccttcttttataaccgaagtggaaagcatcttgccacagaatggaacacagtcagcaagctggtgatgggacttggaatcactgtttgtatcttcatcatgttggccaacctattggtcatggtggcaatctatgtcaaccgccgcttccattttcctatttattacctaatggctaatctggctgctgcagacttctttgctgggttggcctacttctatctcatgttcaacacaggacccaatactcggagactgactgttagcacatggctcctgcgtcagggcctcattgacaccagcctgacggcatctgtggccaacttactggctattgcaatcgagaggcacattacggttttccgcatgcagctccacacacggatgagcaaccggcgggtagtggtggtcattgtggtcatctggactatggccatcgttatgggtgctatacccagtgtgggctggaactgtatctgtgatattgaaaattgttccaacatggcacccctctacagtgactcttacttagtcttctgggccattttcaacttggtgacctttgtggtaatggtggttctctatgctcacatctttggctatgttcgccagaggactatgagaatgtctcggcatagttctggaccccggcggaatcgggataccatgatgagtcttctgaagactgtggtcattgtgcttggggcctttatcatctgctggactcctggattggttttgttacttctagacgtgtgctgtccacagtgcgacgtgctggcctatgagaaattcttccttctccttgctgaattcaactctgccatgaaccccatcatttactcctaccgcgacaaagaaatgagcgccacctttaggcagatcctctgctgccagcgcagtgagaaccccaccggccccacagaaggctcagaccgctcggcttcctccctcaaccacaccatcttggctggagttcacagcaatgaccactctgtggtttagaacggaaactgagatgaggaaccagccgtcctctcttggaggataaacagcctccccctacccaattgccagggcaaggtggggtgtgagagaggagaaaagtcaactcatgtacttaaacactaaccaatgacagtatttgttcctggaccccacaagacttgatatatattgaaaattagcttatgtgacaaccctcatcttgatccccatcccttctgaaagtaggaagttggagctcttgcaatggaattcaagaacagactctggagtgtccatttagactacactaactagacttttaaaagattttgtgtggtttggtgcaagtcagaataaattctggctagttgaatccacaacttcatttatatacaggcttcccttttttatttttaaaggatacgtttcacttaataaacacgtttatgcctatcagcatgtttgtgatggatgagactatggactgcttttaaactaccataattccattttttcccttacataggaaaactgtaagttggaattatcttttgtttagaaagcatgcatgtaatgtatgtatgcagtatgccttacttaaaaagattaaaaggatactaatgttaaatcttctaggaaatagaacctagacttcaaagccagtatttgtttaggtcatgaagcaaacaatgctctaatcacaatattaactgtttaattaaaatgttgtaacaagtataaaacagggaatgtaagtttattaccaaagtgatatgtattccaaaaaagtcatagaagatgaagcactataatattgttcccatatatttaaaatacccaagtacattctaattaccagtatatcagaggaaaattttcgtagtctttgtaaaataatatactcatcatagaaaacttgaaaaatgcagaaatgtataaaaaagcaaaaatgattactgataatatcacaacccagaagtaaccacctttaaaaagcaacccccatgtatgcctatatgtgtattgtatactttttttacataattggagtcatactgtaaacagttttataagtagatctttttcattgcaaaattgccacattttcttatggcattaaaaattttacaaaaacataattttaatggctatattatattccatttaatggatgcaactcagtttatttaaccattcccatgttgttaactatttaggttgtttctaattttcattattataaagttgcagaaatttggtgt

SEQ ID NO: 30 - DNA, 2164 bp, Homo sapiens
cacagagcagaccatcctcctgctgaagtgacaagccacgctgcttctggagccaaagctgaccaagaagaacaaatccaccccagatctagactcaggtcacctcctgaagccctcgttcagggtcgatatccccacatcaaggacggtgaggatcttaaagaccactcaacagaaagtaaaaaaatggaaaattgtctaggagaatccaggcatgaagtagaaaaatcagaaatcagtgaaaacacagatgcttcgggcaaaatagagaaatataatgttccgctgaacaggcttaagatgatgtttgagaaaggtgaaccaactcaaactaagattctccgggcccaaagccgaagtgcaagtggaaggaagatctctgaaaacagctattctctagatgacctggaaataggcccaggtcagttgtcatcttctacatttgactcggagaaaaatgagagtagacgaaatctggaacttccacgcctctcagaaacctctataaaggatcgaatggccaagtaccaggcagctgtgtccaaacaaagcagctcaaccaactatacaaatgagctgaaagccagtggtggcgaaatcaaaattcataaaatggagcaaaaggagaatgtgcccccaggtcctgaggtctgcatcacccatcaggaaggggaaaagatttctgcaaatgagaatagcctggcagtccgttccacccctgccgaagatgactcccgtgactcccaggttaagagtgaggttcaacagcctgtccatcccaagccactaagtccagattccagagcctccagtctttctgaaagttctcctcccaaagcaatgaagtttcaggcacctgcaagagagacctgcgtggaatgtcagaagacagtctatccaatggagcgtctcttggccaaccagcaggtgtttcacatcagctgcttccgttgctcctattgcaacaacaaactcagtctaggaacatatgcatctttacatggaagaatctattgtaagcctcacttcaatcaactctttaaatctaagggcaactatgatgaaggctttgggcacagaccacacaaggatctatgggcaagcaaaaatgaaaacgaagagattttggagagaccagcccagcttgcaaatgcaagggagacccctcacagcccaggggtagaagatgcccctattgctaaggtgggtgtcctggctgcaagtatggaagccaaggcctcctctcagcaggagaaggaagacaagccagctgaaaccaagaagctgaggatcgcctggccaccccccactgaacttggaagttcaggaagtgccttggaggaagggatcaaaatgtcaaagcccaaatggcctcctgaagacgaaatcagcaagcccgaagttcctgaggatgtcgatctagatctgaagaagctaagacgatcttcttcactgaaggaaagaagccgcccattcactgtagcagcttcatttcaaagcacctctgtcaagagcccaaaaactgtgtccccacctatcaggaaaggctggagcatgtcagagcagagtgaagagtctgtgggtggaagagttgcagaaaggaaacaagtggaaaatgccaaggcttctaagaagaatgggaatgtgggaaaaacaacctggcaaaacaaagaatctaaaggagagacagggaagagaagtaaggaaggtcatagtttggagatggagaatgagaatcttgtagaaaatggtgcagactccgatgaagatgataacagcttcctcaaacaacaatctccacaagaacccaagtctctgaattggtcgagttttgtagacaacacctttgctgaagaattcactactcagaatcagaaatcccaggatgtggaactctgggagggagaagtggtcaaagagctctctgtggaagaacagataaagagaaatcggtattatgatgaggatgaggatgaagagtgacaaattgcaatgatgctgggccttaaattcatgttagtgttagcgagccactgccctttgtcaaaatgtgatgcacataagcaggtatcccagcatgaaatgtaatttacttggaagtaactttggaaaagaattccttcttaaaatcaaaaacaaaaaaaaaaaaaaaaaaaaaaaaaaa

SEQ ID NO: 31 - DNA, 532 bp, Homo sapiens
  misc_feature (224)..(224): n is a, c, g, or t
ttttggataaataaatatattttttattcaatattcaatttaatctatattagcctatgtttcactttataggcaatgcgtagttcttaaattccaagctctagaatgctgcttgagactgttctggctgttgtgcatctgagaatgagcttctgggatggcattccttgacactgaaaacttgagaacacatattaccatgaggaagccctctaatcaggcanggaatgatggtggtcaaggaagacttcctggtgaaggtgactcttgaaatcagttgtgaatgacaaatcagaatagcaggagagagaatgttagatggaaataaggcaatctcaacagagagaacagcatgtatatagcacaggttgagaagtaaagggaacaaagagggtaatgaatggaaaaaataagccaggggagatgggatctaagaaacaggtggagataaggctgtattcacaggagacaaaaatggcttaaaggaagagattcacctgtaaatggtaacaagagaatggagagagttcaa

SEQ ID NO: 32 - DNA, 3304 bp, Homo sapiens
gcgaccgaacgcggcggtcggcagcgttcgcgcgggggcctgcgaagcgctgctcggggccggcactgcccgcggggaggacgcgccgccgccgccacccagcgccgccgccgccgccgcctccagccgggccgccgcgcgtcccgggggccggccccgcgagcgcaggagtaaacaccgccggagtcttggagccgctgcagaagggaataaagagagatgcagggatttgtgaggttacggcgccccagctgcaagatgcactagccggctgaacccgggatcggctgacttgttggaaccggagtgctctgcacggagagtggtggatgagttgaagttgccttcccggggctcattttccacgctgccgagaggaatccgagaggcaaggcaatcacttcgtcttgccattgattgggtatcgggagctttttttttctcccctctctctttcttttcctccgtcttgttgcatgcaagaaaattacagtccgctgctcgcccgccctgggtgcgagatattcagccccgctctctcccgtgcattgtgcaacccaaagatgaaagaccgaaggggagaaagttaaagaaatcgcccacatgcgctggatcagtccacggcttggggaaaggcatccagagaaggtgggagcggagagtttgaagtctttacaggcgggaagatggcggactggagctgaaagtgttgattgggaaacttgggtgattcttgtgtttatttacaatcctcttgacccaggcaggacacatgcaggccaaaaaacgctatttcatcctgctctcagctggctcttgtctcgcccttttgttttatttcggaggcttgcagtttagggcatcgaggagccacagccggagagaagaacacagcggtaggaatggcttgcaccaccccagtccggatcatttctggccccgcttcccggagcctctgcgccccttcgttccttgggatcaattggaaaacgaggattccagcgtgcacatttccccccggcagaagcgagatgccaactccagcatctacaaaggcaagaagtgccgcatggagtcctgcttcgatttcaccctttgcaagaaaaacggcttcaaagtctacgtatacccacagcaaaaaggggagaaaatcgccgaaagttaccaaaacattctagcggccatcgagggctccaggttctacacctcggaccccagccaggcgtgcctctttgtcctgagtctggatactttagacagagaccagttgtcacctcagtatgtgcacaatttgagatccaaagtgcagagtctccacttgtggaacaatggtaggaatcatttaatttttaatttatattccggcacttggcctgactacaccgaggacgtggggtttgacatcggccaggcgatgctggccaaagccagcatcagtactgaaaacttccgacccaactttgatgtttctattcccctcttttctaaggatcatcccaggacaggaggggagagggggtttttgaagttcaacaccatccctcctctcaggaagtacatgctggtattcaaggggaagaggtacctgacagggataggatcagacaccaggaatgccttatatcacgtccataacggggaggacgttgtgctcctcaccacctgcaagcatggcaaagactggcaaaagcacaaggattctcgctgtgacagagacaacaccgagtatgagaagtatgattatcgggaaatgctgcacaatgccactttctgtctggttcctcgtggtcgcaggcttgggtccttcagattcctggaggctttgcaggctgcctgcgtccctgtgatgctcagcaatggatgggagttgccattctctgaagtgattaattggaaccaagctgccgtcataggcgatgagagattgttattacagattccttctacaatcaggtctattcatcaggataaaatcctagcacttagacagcagacacaattcttgtgggaggcttatttttcttcagttgagaagattgtattaactacactagagattattcaggacagaatattcaagcacatatcacgtaacagtttaatatggaacaaacatcctggaggattgttcgtactaccacagtattcatcttatctgggagattttccttactactatgctaatttaggtttaaagcccccctccaaattcactgcagtcatccatgcggtgacccccctggtctctcagtcccagccagtgttgaagcttctcgtggctgcagccaagtcccagtactgtgcccagatcatagttctatggaattgtgacaagcccctaccagccaaacaccgctggcctgccactgctgtgcctgtcgtcgtcattgaaggagagagcaaggttatgagcagccgttttctgccctacgacaacatcatcacagacgccgtgctcagccttgacgaggacacggtgctttcaacaacagaggtggatttcgccttcacagtgtggcagagcttccctgagaggattgtggggtaccccgcgcgcagccacttctgggataactctaaggagcggtggggatacacatcaaagtggacgaacgactactccatggtgttgacaggagctgctatttaccacaaatattatcactacctatactcccattacctgccagccagcctgaagaacatggtggaccaattggccaattgtgaggacattctcatgaacttcctggtgtctgctgtgacaaaattgcctccaatcaaagtgacccagaagaagcagtataaggagacaatgatgggacagacttctcgggcttcccgttgggctgaccctgaccactttgcccagcgacagagctgcatgaatacgtttgccagctggtttggctacatgccgctgatccactctcagatgaggctcgaccccgtcctctttaaagaccaggtctctattttgaggaagaaataccgagacattgagcgactttgaggaatccggctgagtgggggaggggaagcaagaagggatgggggtcaagctgctctctcttcccagtgcagatccactcatcagcagagccagattgtgccaactatccaaaaacttagatgagcagaatgacaaaaaaaaaaaaggccaatgagaactcaactcctggctcctgggactgcaccagactgctccaaactcacctcactggcttctgtgtcccaagactaggttggtacagtttaattatggaacattaaataattatttttgaaaaaaaaaaaaaaaaaa

SEQ ID NO: 33 - DNA, 4646 bp, Homo sapiens
gaatgcaggtgagaaaaggcacggactctgcggctgcgaacccaaacttgggcaccgcacggtgcgcactgctcagccttcgcccccgtgggcgaaaggctgctgcggtttcaggcggctgcttcgtgactaatgaccttgcgcagagttgttaagaaaaaagagaaacccgcgctctccggggtgagaagggactgactctgggcgtctctgaagatggctcgggcttctctttggcgcgccggggggaccctgacactgaccgctctgtgacgcgagtagtctcccctgcaccgtgcccgaagcgacgtgccgggggatttttcattctcgatctgttgactggctcccccgctgcatgagcagagtcggagttgagactggcttgttgctggccccagcgcctggtgcaggaagcgactcacgtttgtctgggtggccggagccggagcagagcctgggtttggagtgagtgcctggaacgtgaattggactcaactcgagtagcagcaaagaccagcgggctggcaggcgggggaggctgcaggctcattccccacctcttcccagccccactgcccgtctgccggagcggttctggccccttccgacagagcggggactagagccggggattctccgcccgctgaggggatgactctgggttgggggagcgccgaacccgcggcgcgcagtgtcccgtgaactgtgagtactgcgactgaacggcggcaggcgagcgggcgattagcacccattgcatgaattatgaaacaataactttcggaagaagcaggaggaaaaaaagaagcatctatcgctgccctcccacccccattcccggccaactctccacgccgcttttgccccctccctcccctccctctcgctccttcctttccgggagaggggagaggactcgggggagggcaggcggccggccccggaggaggggggcgccgagggggctgtggttagaaggagcagtagcagcagcagcaggagaagatgctgaggatgcggaccgcgggatgggcgcgcggctggtgcttgggctgctgcctcctcctgccgctctcgctcagcctggcggccgccaagcagctcctccggtaccggctggccgaggagggccccgccgacgtccgcatcggcaacgtggcttcagacctgggcatcgtgaccggatcgggtgaggtgactttcagcctggagtccggttccgagtacctgaagatcgacaacctcactggcgagctgagcacgagcgagcggcgcatcgaccgcgagaagctgccccagtgtcagatgatcttcgacgagaacgagtgcttcctggacttcgaggtgtcggtgatcgggccctcgcagagctgggtggacctgtttgagggtcaggtcatcgtgcttgacatcaacgacaacacgcccaccttcccgtcgcccgtgctcacgctcacggtggaggagaatcggccggtgggcacactttacctgctgcccacagccaccgaccgcgacttcggccgcaacggcatcgagcgctacgagctgctccaggagcccggaggcggcggcagcggcggcgagagccggcgcgccggggcggccgacagcgccccctaccccgggggcggcgggaacggcgcgagcggcggcggctcgggaggctccaagcggcggctggacgcatcagagggcggcggcggcaccaaccccggcggccgcagcagcgtgttcgagctgcaggtggcggacaccccggacggcgagaagcagccgcagctgatcgtgaagggggcgctggaccgcgagcagcgcgactcctacgagctgaccctgcgagtgcgcgacggcggcgacccgcctcgctcctcgcaggccatcctacgggtcctcatcaccgacgtgaacgacaacagcccccgcttcgagaagagcgtgtacgaggccgacttggctgagaacagcgccccggggacccccatcctgcaactgcgcgcagccgacttggacgtgggggtcaacgggcagatcgaatacgtgttcggggcggccaccgagtcggtgaggcggctgctgcgccttgacgagacgtccggctggctcagcgtcctgcaccggatcgaccgcgaggaggtgaaccagctgcgcttcacggtcatggcccgcgaccgcgggcagccccccaagaccgacaaggccaccgtggtccttaacatcaaagacgagaacgacaacgtgccgtccattgaaatccgcaagattgggcgcatccccctcaaggacggggtggccaacgtggccgaggacgttctggtcgacacccccatcgctctggtgcaggtgtccgaccgagaccaaggcgagaacggggtggtcacctgcaccgtggtgggcgacgtgcccttccagctcaagccagccagcgacaccgagggcgaccagaacaagaaaaagtacttcttgcacacctcgacccctctggactatgaggccacccgggagttcaacgtggtcatcgtggcggtggactcaggcagccccagcctctcgagcaacaactccctgattgtcaaggtgggagacaccaacgacaacccgcccatgttcggccagtcggtggtggaggtttacttccctgagaacaacatcccgggcgagagggtggccacggtgctggcgacagacgcagacagcggtaagaacgccgagatcgcctactcgctggactcctctgtgatggggatctttgccatcgatcccgattctggggacatcctggtcaataccgtgctggaccgcgagcagactgacaggtatgagtttaaagttaacgccaaagacaaaggcatccccgtgctgcagggcagcactacggtgattgtgcaggtggctgataaaaatgacaatgaccctaagtttatgcaggacgtcttcaccttttatgtgaaagaaaacttgcagcccaacagccctgtggggatggtcaccgtgatggatgctgacaaggggcggaatgcagagatgagcctgtacatagaggagaacaataacattttttctattgaaaatgacacggggaccatttactccacaatgtcttttgaccgggaacatcagaccacatacactttcagagtcaaggctgtggatgggggagatcctcccagatctgccacagctacagtctcgctttttgtgatggatgaaaatgacaatgctcccacagttacccttcccaaaaacatttcctacactttactgccaccttcgagtaatgtcaggacagtagtagctacagtgttggcaacagacagtgatgatggcatcaatgcagacctgaactacagcattgtgggaggaaatcccttcaagctgtttgaaattgatcccactagtggtgtggtttccttagtgggaaaactcacccaaaagcattatggcttgcacaggttggtggtgcaagtgaatgacagtgggcagccttcccagtccaccacgactctggtgcacgtgtttgtcaatgaaagtgtttctaatgcaactgcgattgactcccagatagctagaagtttgcacatcccactcacccaggatatagctggtgacccaagctatgaaattagcaaacagagactcagtattgtcattggcgtggttgctggcattatgacggtgattctaatcatcttaattgtagtgatggcaaggtactgcaggtccaaaaataaaaatggctatgaagccggcaaaaaagatcacgaagacttttttacaccccaacagcatgacaaatctaaaaagcctaaaaaggacaagaaaaacaaaaaatctaagcagcctctctacagcagcattgtcactgtggaggcttctaagccaaatggacagaggtatgatagtgtcaatgagaagctgtcagacagcccaagcatggggcgatacaggtccgttaatggtgggcccggcagtcctgacctggcaaggcattacaaatctagttccccattgcctactgttcagcttcatccccagtcaccaactgcaggaaaaaaacaccaggccgtacaagatctaccaccagccaacacatttgtgggagcaggagacaacatttcaattggatcagatcactgctctgagtacagctgtcaaaccaataacaagtacagcaaacagatgcgtctacatccatacattactgtgtttggctgaattccactctaatatgatgctccattatgcaccatactgtgatgacctttctactccgaaacctgctggagcctgcccttggccgtggggtgtcagccaatcactgcttgttccacttgttgtacattttatttttgagtctttttctttctcatatacagaaaaatagtatgaaaataaaataaatgtatgaaacagtattaatgcagaaatgtgctactaatggatgtctgagtcaccagaaattccattcttaaagaggcggttagcacctattagacgtaacagtgatgtcttttaaaaaatccaaaagcatattgcaacaataagtttgagactttgtgtgaacaaagggaaattcagcctcttatgtctttgtctttaatacattaaatactgattttgaataaaaatctaaattgatcaat

SEQ ID NO: 34 - DNA, 685 bp, Homo sapiens
ttttttttttttttttgatgatgaaatattttaattaaggtttatttcaatagcaaaaatgacttcaagattttgcgtgaattattttttaaacaaaactatatgaaaaatatgtacaaatcagtcatcaatgtcattgacatttttatgaacaagtttcaaatgaaaaatatcccatcataacaaaggtacataaataaataaatgctgacactacaaggctcggagctccgggcactcagacatcatgagttggtccttgcacccccggaatttaattctctacttctatgctcttttatttctctcttcaacatgtgtagcatatgttgctaccagagacaactgctgcatcttagatgaaagattcggtagttattgtccaactacctgtggcattgcagatttcctgtctacttatcaaaccaaagtagacaaggatctacagtctttggaagacatcttacatcaagttgaaaacaaaacatcagaagtcaaacagctgataaaagcaatccaactcacttataatcctgatgaatcatcaaaaccaaatatgatagacgctgctactttgaagtccaggaaaatgttagaagaaattatgaaatatgaagcatcgattttaacacatgactcaagtattcgatatttgcaggaaatatataattcaaataatcaaaag

SEQ ID NO: 35 - DNA, 2150 bp, Homo sapiens
ctcgagccacgaaggccccgctgtcctgtctagcagatacttgcacggtttacagaaattcggtccctgggtcgtgtcaggaaactggaaaaaaggtcataagcatgaagcgcagttcagtttccagcggtggtgctggccgcctctccatgcaggagttaagatcccaggatgtaaataaacaaggcctctatacccctcaaaccaaagagaaaccaacctttggaaagttgagtataaacaaaccgacatctgaaagaaaagtctcgctatttggcaaaagaactagtggacatggatcccggaatagtcaacttggtatattttccagttctgagaaaatcaaggacccgagaccacttaatgacaaagcattcattcagcagtgtattcgacaactctgtgagtttcttacagaaaatggttatgcacataatgtgtccatgaaatctctacaagctccctctgttaaagacttcctgaagatcttcacatttctttatggcttcctgtgcccctcatacgaacttcctgacacaaagtttgaagaagaggttccaagaatctttaaagaccttgggtatccttttgcactatccaaaagctccatgtacacagtgggggctcctcatacatggcctcacattgtggcagccttagtttggctaatagactgcatcaagatacatactgccatgaaagaaagctcacctttatttgatgatgggcagccttggggagaagaaactgaagatggaattatgcataataagttgtttttggactacaccataaaatgctatgagagttttatgagtggtgccgacagctttgatgagatgaatgcagagctgcagtcaaaactgaaggatttatttaatgtggatgcttttaagctggaatcattagaagcaaaaaacagagcattgaatgaacagattgcaagattggaacaagaaagagaaaaagaaccgaatcgtctagagtcgttgagaaaactgaaggcttccttacaaggagatgttcaaaagtatcaggcatacatgagcaatttggagtctcattcagccattcttgaccagaaattaaatggtctcaatgaggaaattgctagagtagaactagaatgtgaaacaataaaacaggagaacactcgactacagaatatcattgacaaccagaagtactcagttgcagacattgagcgaataaatcatgaaagaaatgaattgcagcagactattaataaattaaccaaggacctggaagctgaacaacagaagttgtggaatgaggagttaaaatatgccagaggcaaagaagcgattgaaacacaattagcagagtatcacaaattggctagaaaattaaaacttattcctaaaggtgctgagaattccaaaggttatgactttgaaattaagtttaatcccgaggctggtgccaactgccttgtcaaatacagggctcaagtttatgtacctcttaaggaactcctgaatgaaactgaagaagaaattaataaagccctaaataaaaaaatgggtttggaggatactttagaacaattgaatgcaatgataacagaaagcaagagaagtgtgagaactctgaaagaagaagttcaaaagctggatgatctttaccaacaaaaaattaaggaagcagaggaagaggatgaaaaatgtgccagtgagcttgagtccttggagaaacacaagcacctgctagaaagtactgttaaccaggggctcagtgaagctatgaatgaattagatgctgttcagcgggaataccaactagttgtgcaaaccacgactgaagaaagacgaaaagtgggaaataacttgcaacgtctgttagagatggttgctacacatgttgggtctgtagagaaacatcttgaggagcagattgctaaagttgatagagaatatgaagaatgcatgtcagaagatctctcggaaaatattaaagagattagagataagtatgagaagaaagctactctaattaagtcttctgaagaatgaagataaaatgttgatcatgtatatatatccatagtgaataaaattgtctcagtaaaaaaaaaaaaaaaaaaaaaaaaaaaaaaaaaaaaaaaaaaaaaaaaaaaaaaaaaaaaaaaa

SEQ ID NO: 36 - DNA, 631 bp, Homo sapiens
attgaagtgacttgaagtgaccttttgtgctttaggtgcaggttgacactgaaaaaaaaacaaaacgctgaatttttcacacctatgtctgcattaaaggctgttttactaccggaagttacatagacttcctgcagtcagctgctgtgccccagtgccttactggtcctttgtagatttgccttaatgatttgtacaaatgactgggaggcggggatgctgcctgtgtcctggtgaaccttaatgaaggggccgtcttaggcacagtgcaaaacaagcatttgtcctgtactgttagagccaaaattgtgatgagcaatactgataattgtccagtttatgtcatctttcccagattttaaaatctgttctagatattcttagcttgaaccacttttgattgtgaaatgtattaggtgttgtcccattattactgtaaaatgaagttttgaatcttcttgttaataaactgtggatttcccctctcaatttcttaaacaacaacaaaaaaatgcttgaagattgtctttgagtgtaagatctgccttttcagaaagggagtgttagtttgtaatgttaaaaaataaagacctcattcaataaaagttgaagtcatcttttaaaaaaaaaa

SEQ ID NO: 37 - DNA, 862 bp, Homo sapiens
  misc_feature (21)..(21): n is a, c, g, or t
agccaccgccgcgtccctctntccacgaggctgccggcttaggacccccagctccgacatgtcgccctctggtcgcctgtgtcttctcaccatcgttggcctgattctccccaccagaggacagacgttgaaagataccacgtccagttcttcagcagactcaactatcatggacattcaggtcccgacacgagccccagatgcagtctacacagaactccagcccacctctccaaccccaacctggcctgctgatgaaacaccacaaccccagacccagacccagcaactggaaggaacggatgggcctctagtgacagatccagagacacacaagagcaccaaagcagctcatcccactgatgacaccacgacgctctctgagagaccatccccaagcacagacgtccagacagacccccagaccctcaagccatctggttttcatgaggatgaccccttcttctatgatgaacacaccctccggaaacgggggctgttggtcgcagctgtgctgttcatcacaggcatcatcatcctcaccagtggcaagtgcaggcagctgtcccggttatgccggaatcattgcaggtgagtccatcagaaacaggagctgacaacccgctgggcacccgaagaccaagccccctgccagctcaccgtgcccagcctcctgcatcccctcgaagagcctggccagagagggaagacacagatgatgaagctggagccagggctgccggtccgagtctcctacctcccccaaccctgcccgcccctgaaggctacctggcgccttgggggctgtccctcaagttatctcctctgttaagacaaaaagtaaagcactgtggtctttgca

SEQ ID NO: 38 - DNA, 375 bp, Homo sapiens
cagcgccggctgcgagactggggccgtggctgctggtcccgggtgatgctaggcggctccctgggctccaggctgttgcggggtgtaggtgggagtcacggacggttcggggcccgaggtgtccgcgaaggtggcgcagccatggcggcaggggagagcatggctcagcggatggtctgggtggacctggagatgacaggattggacattgagaaggaccagattattgagatggcctgtctgataactgactctgatctcaacattttggctgaaggcacttgatgacattagtgaaagcatcaaagagcttcagttttaccgaaataacatcttcaaaaaaaaaaaaaaaaaaaaaaaaaaaaaaaaaaaaaa

SEQ ID NO: 39 - DNA, 591 bp, Homo sapiens
gttggcaaaatatattttatttgttcatacaaagaaatagtatgaattaccagaatttcacttgcctagaaacatctttctctgtgtaaaattaatttgtgttatacataggacaaaatacttgatttaattttttgtacatattggctatcctaacatccaagttatcgaagacatactgctagaatttgcacagtattttagattacttggttgaatgagactcagtgataaattaatgtcacaaaagtgagaaaacatctaaccacacctttaagttttattggccatcctcttgataagctgaaaagtcacattagcttctgtgtcagcatcttagatacgtactgtttctagtttattggaatcttccattttccttttttacaaaaatatcctggaaggatctgaaactgtttctccaaatgtctaaaatatatctgtcacacaaaatgacccccaaagagaatcctgggaagaaaacaatttctcctcctccatcatccaattaagtatttattaaacagtcactatacttaaaatacctttccaggtaccacctactaagttaacaaactactgttcaaacac

SEQ ID NO: 40 - DNA, 510 bp, Homo sapiens
caggcatattagctttaatgtaggtggcgatgagtttttaggccaaggaaggaataatgttttatgtaccaaagccttttgtccccattttccgtcatacgaatagtattccctgttgctaagccgatgatacattacccttttcccataggtgtgagtggcggtctgaatggagaagttcaatagttctgattgcagatcctatgcaggagagataataaggaaaataatctttgtctcctggattaagctgaggctggcaaagagtgaaatgtcccaagccctctaacaacaaacgacatactttgtgttgtcctggatgctggtctggttgccaaatatgtggaactggccccatatgcgtgtactgttgtccatttcatgagagtaggctcgaggacaccatgggcaaggatctgatggttgccagcctaagcgttttagacttttgacccagagatttattgttttgggtgtggaaaaaattttccagtgaagggtctcaagata

SEQ ID NO: 41 - DNA, 2387 bp, Homo sapiens
cctcgtgccgcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcatgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccagtacgtcttcaaataccatctcagcaggctgggagccaaatgaagaaaatgaagatgaaagagacagacacctcagtttttctggatcaggcattgatgatgatgaagattttatctccagcaccatttcaaccacaccacgggcttttgaccacacaaaacagaaccaggactggacccagtggaacccaagccattcaaatccggaagtgctacttcagacaaccacaaggatgactgatgtagacagaaatggcaccactgcttatgaaggaaactggaacccagaagcacaccctcccctcattcaccatgagcatcatgaggaagaagagaccccacattctacaagcacaatccaggcaactcctagtagtacaacggaagaaacagctacccagaaggaacagtggtttggcaacagatggcatgagggatatcgccaaacacccagagaagactcccattcgacaacagggacagctgcagcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtacaacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactcttaaaaaaaaaaaaaaaaaaaaa

SEQ ID NO: 42 - DNA, 738 bp, Homo sapiens
atcaactttgatttgagttagggcttagctcatggttgaagaaaagtggaaaataacaagtgcccatttaggtttgaagaatccagaatgttttaccttgtgactttatgagttatagaagctgggtttggctctaggtttcatgttcccaaatgagccatctgtcagtatattcacttaattcttactaatttcagtttccgtgtaaaggaaacaagttacatattgatgcttaaatccagaaagtgtaaaaggtttgtcttaaagtgttaaaatatagtgtctgatataaaggatgtaagttactcagctttgctgtccctaagccaaacagtgttgtgtcttcagtgtgaagatttaatggtaaaaacgtactttgtaatgtcagagattatagatcatattattaataaaatggacctgggtctaatattttttttgcttaaaaaaaaagaatatatataaaaaacaacgtgtgcgcggcgagtgtggccgctggaaaaagtttgcaaacccattccttcggggggccgcgggccccaaattgttcaagtgaaccatgggctataacgtcggtgccaaaaggagaccgtggtcgaacgactaagtgtgggttttgctcaccataaaaaaacgcgcgggggaaccgggctttctgaacaatccaggtgggggttcggagccacctggactacccaagagtccagaagcgtatataccggcgcggggaggggagga

SEQ ID NO: 43 - DNA, 1648 bp, Homo sapiens
actctgcctccaaagccaccgtccccccgaggcaccactgcatcccccaaggggcgggttcggaggaaggaggaggcaaaggagagccccagcgccgcagggcccgaggacaagagccagagcaagcgcagggccagtaacgagaaggagtcagcagccccagcctcaccggcaccttcgccggcgccctcgcccaccccagccccgccccagaaggagcagccccccgcggagacccctacagacgctgctgtcttgacctcacccccagcccctgctcccccggtgacccctagcaaaccaatggccggcaccacagaccgagaagaagccactcggctcttggctgagaagcggcgccaggcccgggagcagcgggagcgcgaggagcaggagcggaggctgcaggcagaaagggacaagcgaatgcgagaggagcagctggcacgggaggccgaggcccgggcggagcgggaggcggaggcccggaggcgggaggagcaggaggcacgagagaaggcgcaggccgagcaggaggagcaggagcggctgcagaagcagaaagaggaggccgaagctcggtcgcgggaagaggcggagcggcagcgtctggagcgggaaaagcacttccagcagcaggagcaagagcggcaagagcgcagaaagcgtctggaggagatcatgaagaggactcggaagtcagaagtttctgaaaccaagaagcaggacagcaaggaggccaacgccaacggttccagcccagagcctgtgaaagctgtggaggctcggtccccagggctgcagaaggaggctgtgcagaaagaggagcccatcccacaggagcctcagtggagtctcccaagcaaggagttgccagcgtccctggtgaatggcctgcagcctctcccagcacaccaggagaatggcttctccaccaacggaccctctggggacaagagtctgagccgaacaccagagacactcctgccctttgcagaggcagaagccttcctcaagaaagctgtggtgcagtccccgcaggtcacagaagtcctttaagagggtttgccttggatccgggcacagttgtgagggctcctctgcatcacctaccaggatgtctggaggagaaaaagacagaacaaagatggaagtggcctgggcccctgggggtgggtcctctctgttgtttttaatctgcaccttatagactgatgtctctttggccggagccagatctgcccctcagtgcattcgtgtgctcgcacgcgcagacatcccttctcccccatacacacatatacactcacagcctctctggcctcttcccttggggaggggccacctgtagtatttgccttgatttggtggggtacagtggatgtgaatactgtaaatagcttgtgctcagactcctctgcgtggagagggtgggtgcaggaggcagaccctccccccaaagccccctggggagatcttcctctctctatttaactgtaactgagggggatcccaggtctggggatgggggacaccttgggccacaggatactggttgcttcaggggtacccatgccccctgccctcgcctggaatcagtgttactgcatctgattaaatgtctccagaaataaagaataattctgcc

SEQ ID NO: 44 - DNA, 922 bp, Homo sapiens
taggcccccaaaatgatcgtagtacatgccagtcatttctcagtgaaataaatacaataccagagtacattatgggttttattgctttcttttatggtagacctgttaatggggaaaaaatacatcaaatcaaatagaatcttatatctgtatgttaaaatagagcacttacctgaagtcagtggcctggatcatagccctggatcatttcccagtctgtcctgtgctgtgtgaccttggacaaggcgcttcatctctctgggcctctatttctccatttgtaaaacaagtggctgcagtagatgatggctgagagcccttcctgttcccagatgccttggtccaaagaccccacccctctgctggtcctgccaacgtgttggtgctataagctgcttcagatataaaattggtttatctataatgtttgttcatttaatagcttctaaaaggccttttgttatacagtgctttttttctagttttatggacttgattactgtaataatgtcttgtttttagccatgtaactacaaacagatattctcttgatgtcttagtaaatttgcatttgatatatcattgatgagatttgtgtatgtatattctttggctacgcatctgtccagcatcttataaccataatactgtgatcattcattttggaaatatgtcctatggaaagaataaaagcatgtacttcacagtagcatgttccacagatttgcacgagttcattaaaagccccttgctttctgaacaaaaaaaagggggcggtcaaagttcccgaggcccagttagcgtcccggttttgcaaagggccttaggacgttaagagacgcgggtacacctgggaagggtgggtgggaccccggtggacggacccgagaccggaaggtaggggtgtcggggtcgtaacggg

SEQ ID NO: 45 - DNA, 1573 bp, Homo sapiens
gagcatgaatctgaatatggggagagagatgaaagaagagctggaggaagaggagaaaatgagagaggatgggggaggtaaagatcgggccaagagtaaaaaggtccacaggattgtctcaaaatggatgctgcccgaaaagtcccgaggaacatacttggagagagctaactgcttcccgcctcccgtgttcatcatctccatcagcctggccgagctggcagtgtttatttactatgctgtgtggaagcctcagaaacagtggatcacgttggacacaggcatcttggagagtccctttatctacagtcctgagaagagggaggaagcctggaggtttatctcatacatgctggtacatgctggagttcagcacatcttggggaatctttgtatgcagcttgttttgggtattcccttggaaatggtccacaaaggcctccgtgtggggctggtgtacctggcaggagtgattgcagggtcccttgccagctccatctttgacccactcagatatcttgtgggagcttcaggaggagtctatgctctgatgggaggctattttatgaatgttctggtgaattttcaagaaatgattcctgcctttggaattttcagactgctgatcatcatcctgataattgtgttggacatgggatttgctctctatagaaggttctttgttcctgaagatgggtctccggtgtcttttgcagctcacattgcaggtggatttgctggaatgtccattggctacacggtgtttagctgctttgataaagcactgctgaaagatccaaggttttggatagcaattgctgcatatttagcttgtgtcttatttgctgtgtttttcaacattttcctatctccagcaaactgacctgcccctattgtaagtcaattaataaaaagagccatctggaggaaataaaaaaaaaaggaagactctatgaagaaacagagaagtctcagaaaaggctaacaattttatatagaggacaaaacagcattaaactcatcagttgcaaagattgcctataaaaggaccttaggatttaaggaaggggcttcttaatgtagaaagggaactacaaagatgagaaattaccagaagcctcgccttttcctaagcaccagcggaaggagctgtgccccgggatggagtgagggtggagggcgcgtcagccacgggtgggccttgtgtcgcctcgtatcggcccaggtaggttgttggcctcttacttgggctgacctgacccccgaaagagaaacagacaactctgttctcaggattggggatggacggcttcggccaagcgttttagcctcattcactcaggccccactcagcactctgccagccaagaccattgatttggaaaatccggtccccacccgctaatgagctgttgacactgttgttccttgctgaattggattgttgacttgtagttcagaggcgtacaactagttggcgattagacttgttatgtgatgttaccagcctgaaatgcgatcaccccgtaggaaataaagcaggcatctctggacctcaaaaaaaaaaaaaaaa

SEQ ID NO: 46 - DNA, 478 bp, Homo sapiens
ttgacgctcaaaccatttttatttccaatatgtatttcaatacatgtttgtttccacttttcccagtgccacacacacacacacacaaaaacaaaacaaaacaaaaaaaaacagtcacaagttggattacattagaattggtgccacagttaactttttaaaagcattttaataaccacccaactcttagattttgcagtttagggacttcaagttcagaaccaaaaagcagagaatcgtttcatgtgacatgatgtttctatagacctcttgctctctaggtgacaatgcagagccagggcaaaggtgtttaagctttgtcaccttccacagctttgtggccacattcatatttagataagctcggactctgctcccctcttctggagatggggagaggcaagtgtgtatgtgttgtcatacttactgcattaattcttcactcgaaccgtttacatcagcgaataaacccattgtt

SEQ ID NO: 47 - DNA, 3059 bp, Homo sapiens
gttcggtggtgtcccggtgcagccacgcgagagtagaagggtggaaaggggaggtgcccagtgaaatggagcctgtcccgtgcactttcgggcatttcgagcatcttgtgggctctcccaagtcgcggcccctcctctgagagccacagtcaggtctgtcctcaggggtcgaggcggctgcgctggggcctcggcccgggaggaggcggggggcacggcctttccattttccctgctcccctctgcagaagcctcatagggcccggcgcggcggctcacgcctgtcattcccagcgctttgggcggattgggtaggaggattacttgaggccaggagttcaagaccaggcagggcaacatagggagaccccccccccaaccatctctaatggaaaaaaaaaaaaaagtctccacatccagcgttgtgccttttctctataaggaacagcatctctgccttcctgttcacggtgaccttcgcttggtgtcctcctggcctcagcaacctgacaattctgtcgtgtcccgagagatggctaatgaatggcgcttgatgacagatgagtaatgcctgttgctgaaagattgacgatcatctttctcaagatgttttctgtcttcatgagtcaaaatttgaagaggaaaggatggtggctgggtggttgacaaattactctcaggactcagtgacctttgaggatgtggctgtggacttcacccaggaggagtggactttgctggatcaaactcagagaaacttatacagagatgtgatgctggagaactataagaatctagttgcagtagattgggagagtcatattaataccaaatggtcagcacctcagcagaattttttgcaggggaaaacatccagtgtggtggaaatggagagaaaccattttggagaggaactgtttgactttaaccaatgtgaaaaagccttgagtgaacactcatgccttaagactcacaggagaacttactttagaaagaaaacctgtgagtgtaatcaatgtgaaaaagccttcagaaaaccctctatctttactttacacaagaaaactgatatcggagaggaacttcctaactgtaatcaatgtgaaacagccttcagccaacatctacatcttgtttgcaagaaaactagccaaaatctacatcttgtttgcaagaaaactcacactcaagagaaaccatataaatgcagtgactgtgaaaaaggcttaccttcctcctcacacctcagagaatgtgtaagaatttatggtggagagagaccatatactcataaggagtatgtcgaaaccttttctcattctacagccctttttgtacacatgcaaactcaagatggagaaaaattctatgaatgtaaagcatgtgggaaacccttcactgagtcgtcatatcttactcaacatttaagaactcatagtagagtgttacctatagaacataagaaatttggcaaagcctttgctttttccccagatcttgctaaacatataagacttagaactagaggaaaacactatgtttgtaatgaatgtggcaaagaatttacttgtttctcaaaactcaacattcacataagggttcacactggagaaaaaccgtatgagtgcaacaaatgtgggaaagccttcactgattcatcaggtcttataaaacacaggcgaactcacactggagaaaagccttatgaatgtaaggaatgtgggaaagcttttgctaactcttcacatcttactgtacatatgagaactcacactggtgagaagccttatcaatgtaaggaatgtggaaaagcctttattaattcctcttcctttaaaagtcacatgcagactcatcctggtgtaaaaccctatgactgtcaacagtgtgggaaagccttcattcgatcctcatttcttattcgacatttgagaagtcacagtgcagaaaggccttttgaatgtgaggaatgtgggaaagcctttagatactcctcgcaccttagtcaacataaaagaatacatacaggggagaggccatataaatgtcaaaagtgtgggcaagccttcagtatctcatcaggccttacagtacacatgagaactcacactggtgaacggccctttgaatgtcaggaatgtgggaaagcctttactcggtccacatatcttattcgacatctaagaagtcatagtgtggagaaaccatataaggaatgtgggcaaacctttagtaattcctcatgccttactgaatgtgtgtgaattggggctgatacttggaaagaatgtggtaaagccactacttcctcacacttactgaacatgtactcattcatagtggcaatgtacacagtcataaggaatgtgggaagccttccttggtgtctcagatcttaacaattccaatagaagagaagacatatgaatgtaaggaatgtgggaaaatcttggctccttccataggccttactattcatgtgtctgtgcatcctaggaaacaaactgaacgtaggaaacctgtcgatgcttacatcttactgagtctgtttgaactcatgctggagagaaatgctatgaatgtgaggaaggtggaaaagctttcattattttcctcgggccttactgagcttgtgagcacattggatataaatgcacgtcctctggctgtaaggaatgtgttgaaacctttcactctgccttataccttaatattcagctgtgatctcacaagtgtgaaaaatcttatgaatgtaaaatgtgtggagattcttctttgtttttagcttccactttgggaacatgtcaaagcacacattgagaagtcccatgagtgaaagagatgttggaaagcccttgaacttggtcgttaggaaacatccacactgaagaggaacctgactgtatggaaggtcaaaaaggctgtattaatttacatgcaaaaagtcacactagaggaatgccatatcagaatgcttttggtaaatatacatgttttaaagaggttatatatcattaataaaaatatctagctggtctgaaaaaaaaaaaaaaaaaaaa

SEQ ID NO: 48 - DNA, 3667 bp, Homo sapiens
tatatcatgtaagctagtcacacctatttgaattcacttttctttgtttcttgatttcttatggctattattgcaacaatcaaacaaattttgaataccttttgtgagctagcactgtggaaatatgagggaagtttattgtgttcttactttaaatagtttgcagttttattgtgtatacaaatgtatgcatgtgaaatatacagattttaaaaaagcagatcattaaagattaggtcataaggtgtagtctgtacatggaggaagagctaagttgattcagaataacatggttagatttcgaagctagcctggatttgaatcttggatccaccactgactagctatgtaagcttagtcaagcaactcaacggaggaggcgaggagcgccgggtaccgggccgggggagccgcgggctctcggggaagagacggatgatgaacaagctttacatcgggaacctgagccccgccgtcaccgccgacgacctccggcagctctttggggacaggaagctgcccctggcgggacaggtcctgctgaagtccggctacgccttcgtggactaccccgaccagaactgggccatccgcgccatcgagaccctctcgggtaaagtggaattgcatgggaaaatcatggaagttgattactcagtctctaaaaagctaaggagcaggaaaattcagattcgaaacatccctcctcacctgcagtgggaggtgttggatggacttttggctcaatatgggacagtggagaatgtggaacaagtcaacacagacacagaaaccgccgttgtcaacgtcacatatgcaacaagagaagaagcaaaaatagccatggagaagctaagcgggcatcagtttgagaactactccttcaagatttcctacatcccggatgaagaggtgagctccccttcgccccctcagcgagcccagcgtggggaccactcttcccgggagcaaggccacgcccctgggggcacttctcaggccagacagattgatttcccgctgcggatcctggtccccacccagtttgttggtgccatcatcggaaaggagggcttgaccataaagaacatcactaagcagacccagtcccgggtagatatccatagaaaagagaactctggagctgcagagaagcctgtcaccatccatgccaccccagaggggacttctgaagcatgccgcatgattcttgaaatcatgcagaaagaggcagatgagaccaaactagccgaagagattcctctgaaaatcttggcacacaatggcttggttggaagactgattggaaaagaaggcagaaatttgaagaaaattgaacatgaaacagggaccaagataacaatctcatctttgcaggatttgagcatatacaacccggaaagaaccatcactgtgaagggcacagttgaggcctgtgccagtgctgagatagagattatgaagaagctgcgtgaggcctttgaaaatgatatgctggctgttaacacccactccggatacttctccagcctgtacccccatcaccagtttggcccgttcccgcatcatcactcttatccagagcaggagattgtgaatctcttcatcccaacccaggctgtgggcgccatcatcgggaagaagggggcacacatcaaacagctggcgagattcgccggagcctctatcaagattgcccctgcggaaggcccagacgtcagcgaaaggatggtcatcatcaccgggccaccggaagcccagttcaaggcccagggacggatctttgggaaactgaaagaggaaaacttctttaaccccaaagaagaagtgaagctggaagcgcatatcagagtgccctcttccacagctggccgggtgattggcaaaggtggcaagaccgtgaacgaactgcagaacttaaccagtgcagaagtcatcgtgcctcgtgaccaaacgccagatgaaaatgaggaagtgatcgtcagaattatcgggcacttctttgctagccagactgcacagcgcaagatcagggaaattgtacaacaggtgaagcagcaggagcagaaataccctcagggagtcgcctcacagcgcagcaagtgaggctcccacaggcaccagcaaaacaacggatgaatgtagcccttccaacacctgacagaatgagaccaaacgcagccagccagatcgggagcaaaccaaagaccatctgaggaatgagaagtctgcggaggcggccagggactctgccgaggccctgagaaccccaggggccgaggaggggcggggaaggtcagccaggtttgccagaaccaccgagccccgcctcccgccccccagggcttctgcaggcttcagccatccacttcaccatccactcggatctctcctgaactcccacgacgctatcccttttagttgaactaacataggtgaacgtgttcaaagccaagcaaaatgcacaccctttttctgtggcaaatcgtctctgtacatgtgtgtacatattagaaagggaagatgttaagatatgtggcctgtgggttacacagggtgcctgcagcggtaatatattttagaaataatatatcaaataactcaactaactccaatttttaatcaattattaatttttttttctttttaaagagaaagcaggcttttctagactttaaagaataaagtctttgggaggtctcacggtgtagagaggagctttgaggccacccgcacaaaattcacccagagggaaatctcgtcggaaggacactcacggcagttctggatcacctgtgtatgtcaacagaagggataccgtctccttgaagaggaaactctgtcactcctcatgcctgtctagctcatacacccatttctctttgcttcacaggttttaaactggttttttgcatactgctatataattctctgtctctctctgtttatctctcccctccctcccctccccttcttctccatctccattcttttgaatttcctcatccctccatctcaatcccgtatctacgcaccccccccccccaggcaaagcagtgctctgagtatcacatcacacaaaaggaacaaaagcgaaacacacaaaccagcctcaacttacacttggttactcaaaagaacaagagtcaatggtacttgtcctagcgttttggaagaggaaaacaggaacccaccaaaccaaccaatcaaccaaacaaagaaaaaattccacaatgaaagaatgtattttgtctttttgcattttggtgtataagccatcaatattcagcaaaatgattcctttctttaaaaaaaaaaaatgtggaggaaagtagaaatttaccaaggttgttggcccagggcgttaaattcacagatttttttaacgagaaaaacacacagaagaagctacctcaggtgtttttacctcagcaccttgatcttgtgtttcccttagagattttgtaaagctgatagttggagcatttttttatttttttaataaaaatgagttggaaaaaaaataagatatcaactgccagcctggagaaggtgacagtccaagtgtgcaacagctgttctgaattgtcttccgctagccaagaacctatatggccttcttttggacaaaccttgaaaatgtttatttaaaaaaaaaaaaaaaaaa

SEQ ID NO: 49 - DNA, 1682 bp, Homo sapiens
cctgctgaggccaagctcggatccggtgccgagccaagcggggccgtgcgtcgccggccttcgctcgcgtgacctccgccgtcctccccaaccctcgtcctctgcgcctgcggccgcagccccagcgcccctcgcctaacctcccgccgggccgcgcctcctcctcctcctgctccccgccgcttccgtttctcgagggaaaggctgctgcctcctgctctgtcctcatccccggcttagctgacggcccagaggtgggtgccaattccaccagcagctgcaactgaaaagcaaggttcagaaatgtcagatatcctccgggagctgctctgtgtctctgagaaggctgctaacattgcccgggcgtgcagacagcaggaagccctcttccagctgctgatcgaagaaaagaaagagggagaaaagaacaagaagtttgcagttgacttcaagactctggctgatgtactggtacaggaagttataaaacagaatatggagaacaagtttccaggcttggaaaaaaatatttttggagaagaatccaatgagtttactaatgactggggggaaaagattaccttgaggttgtgttcaacagaggaagaaacagcagagcttcttagcaaagtcctcaatggtaacaaggtagcatctgaagcattagccagggttgttcatcaggatgttgcctttactgacccaactctggattccacagagatcaatgttccacaggacattttgggaatttgggtggaccccatagattcaacttatcagtatataaaaggttctgctgacattaaatccaaccagggaatcttcccctgtggacttcagtgtgtcaccattttaattggtgtctatgacatacagacaggggttcccctgatgggagtcatcaatcaaccttttgtgtcacgagatccaaacaccctcaggtggaaaggacagtgctattggggcctttcttacatggggaccaacatgcattcactacagctcaccatctctagaagaaacggcagtgaaacacacactggaaacaccggctctgaggcagcattctcccccagtttttcagccgtaattagtacaagtgaaaaggagactatcaaagctgcattgtcacgtgtgtgtggagatcgcatatttggggcagctggggctggttataagagcctatgtgttgtccaaggcctcgttgacatttacatcttttcagaagataccacattcaaatgggactcttgtgctgctcatgccatactgcgggccatgggtgggggaatagtagacttgaaagaatgcttagaaagaaatccagaaacagggcttgatttgccacagttggtgtaccacgtggaaaatgagggtgctgctggggtggatcggtgggccaacaagggaggactcattgcatacagatccaggaagcggctggagacattcctgagcctcctggtccaaaacctggcacctgcagagacgcatacctagaggaactctaaccccggtgtacctgtataaactgaactgtgaaactgtttcggttatctctgtcttttgaggatggctttgtcctgttgctggttaacattcaccttcctcttttgaggagtatttttccattatgtattcataataatgttaatttcaataaatgacattcatgcagc

SEQ ID NO: 50 - DNA, 734 bp, Homo sapiens
agccaattgcccaatttctaccctaatccaaagtccctggtgtgggtggggttaaacgtgctggtgcatcctaggtcatccaagagtgagcgccaagtcctgagaaggggcacagaactccctggagggtggagatggagcacctgccccccatggcagggtacactctccccacagccttcctccccaccatcccgtggggactctcgggatttaagcactcgtctctctgggaggcccagaccccactccatttataggcacatctccttcatttcctaggtcactgcccctttgtttacagctcctgcctcctcccttgaccacagcctggtttacaaattccatcagctcccagccccacctgccaaagtcccaggtttacaagccacgcttacttgctgtgtctgcgtggaattctctcctctgtcccctccagtctcctcattggagtgacctgaaggtgtggcttcctccactttttctcagtattactttgccttagttttccccaagagggaaggctggaactcttaactctgtaccccttgatagttatttaattctgtttctcctagtggttcacaattgaactgaattgagatggtgtcgggtggctaaggagacacctcactctccttccccattgtgccgctttatcaattgcctgtttgtgtgtcgttctaacttccattataaatggagtctcttcagcaagagcaagaaaaaaaaag

SEQ ID NO: 51 - DNA, 5306 bp, Homo sapiens
cggggcaggctgctcccggggtaggtgagggaagcgcggaggcggcgcgcgggggcagtggtcggcgagcagcgcggtcctcgctaggggcgcccacccgtcagtctctccggcgcgagccgccgccaccgcccgcgccggagtcaggcccctgggcccccaggctcaagcagcgaagcggcctccgggggacgccgctaggcgagaggaacgcgccggtgcccttgccttcgccgtgacccagcgtgcgggcggcgggatgagagggagccatcgggccgcgccggccctgcggccccgggggcggctctggcccgtgctggccgtgctggcggcggccgccgcggcgggctgtgcccaggcagccatggacgagtgcacggacgagggcgggcggccgcagcgctgcatgcccgagttcgtcaacgccgctttcaacgtgactgtggtggccaccaacacgtgtgggactccgcccgaggaatactgtgtgcagaccggggtgaccggggtcaccaagtcctgtcacctgtgcgacgccgggcagccccacctgcagcacggggcagccttcctgaccgactacaacaaccaggccgacaccacctggtggcaaagccagaccatgctggccggggtgcagtaccccagctccatcaacctcacgctgcacctgggaaaagcttttgacatcacctatgtgcgtctcaagttccacaccagccgcccggagagctttgccatttacaagcgcacacgggaagacgggccctggattccttaccagtactacagtggttcctgcgagaacacctactccaaggcaaaccgcggcttcatcaggacaggaggggacgagcagcaggccttgtgtactgatgaattcagtgacatttctcccctcactgggggcaacgtggccttttctaccctggaaggaaggcccagcgcctataactttgacaatagccctgtgctgcaggaatgggtaactgccactgacatcagagtaactcttaatcgcctgaacacttttggagatgaagtgtttaacgatcccaaagttctcaagtcctattattatgccatctctgattttgctgtaggtggcagatgtaaatgtaatggacacgcaagcgagtgtatgaagaacgaatttgataagctggtgtgtaattgcaaacataacacatatggagtagactgtgaaaagtgtcttcctttcttcaatgaccggccgtggaggagggcaactgcggaaagtgccagtgaatgcctgccctgtgattgcaatggtcgatcccaggaatgctacttcgaccctgaactctatcgttccactggccatgggggccactgtaccaactgccaggataacacagatggcgcccactgtgagaggtgccgagagaacttcttccgccttggcaacaatgaagcctgctcttcatgccactgtagtcctgtgggctctctaagcacacagtgtgatagttacggcagatgcagctgtaagccaggagtgatgggggacaaatgtgaccgttgccagcctggattccattctctcactgaagcaggatgcaggccatgctcttgtgatccctctggcagcatagatgaatgtaatgttgaaacaggaagatgtgtttgcaaagacaatgtcgaaggcttcaattgtgaaagatgcaaacctggattttttaatctggaatcatctaatcctcggggttgcacaccctgcttctgctttgggcattcttctgtctgtacaaacgctgttggctacagtgtttattctatctcctctacctttcagattgatgaggatgggtggcgtgcggaacagagagatggctctgaagcatctctcgagtggtcctctgagaggcaagatatcgccgtgatctcagacagctactttcctcggtacttcattgctcctgcaaagttcttgggcaagcaggtgttgagttatggtcagaacctctccttctcctttcgagtggacaggcgagatactcgcctctctgccgaagaccttgtgcttgagggagctggcttaagagtatctgtacccttgatcgctcagggcaattcctatccaagtgagaccactgtgaagtatgtcttcaggctccatgaagcaacagattacccttggaggcctgctcttaccccttttgaatttcagaagctcctaaacaacttgacctctatcaagatacgtgggacatacagtgagagaagtgctggatatttggatgatgtcaccctggcaagtgctcgtcctgggcctggagtccctgcaacttgggtggagtcctgcacctgtcctgtgggatatggagggcagttttgtgagatgtgcctctcaggttacagaagagaaactcctaatcttggaccatacagtccatgtgtgctttgcgcctgcaatggacacagcgagacctgtgatcctgagacaggtgtttgtaactgcagagacaatacggctggcccgcactgtgagaagtgcagtgatgggtactatggagattcaactgcaggcacctcctccgattgccaaccctgtccgtgtcctggaggttcaagttgtgctgttgttcccaagacaaaggaggtggtgtgcaccaactgtcctactggcaccactggtaagagatgtgagctctgtgatgatggctactttggagaccccctgggtagaaacggccctgtgagactttgccgcctgtgccagtgcagtgacaacatcgatcccaacgcagttggaaattgcaatcgcttgacgggagaatgcctgaagtgcatctataacactgctggcttctattgtgaccggtgcaaagacggattttttggaaatcccctggctcccaatccagcagacaaatgcaaagcctgcaattgcaatccgtatgggaccatgaagcagcagagcagctgtaaccccgtgacggggcagtgtgaatgtttgcctcacgtgactggccaggactgtggtgcttgtgaccctggattctacaatctgcagagtgggcaaggctgtgagaggtgtgactgccatgccttgggctccaccaatgggcagtgtgacatccgcaccggccagtgtgagtgccagcccggcatcactggtcagcactgtgagcgctgtgaggtcaaccactttgggtttggacctgaaggctgcaaaccctgtgactgtcatcctgagggatctctttcacttcagtgcaaagatgatggtcgctgtgaatgcagagaaggctttgtgggaaatcgctgtgaccagtgtgaagaaaactatttctacaatcggtcttggcctggctgccaggaatgtccagcttgttaccggctggtaaaggataaggttgctgatcatagagtgaagctccaggaattagagagtctcatagcaaaccttggaactggggatgagatggtgacagatcaagccttcgaggatagactaaaggaagcagagagggaagttatggacctccttcgtgaggcccaggatgtcaaagatgttgaccagaatttgatggatcgcctacagagagtgaataacactctgtccagccaaattagccgtttacagaatatccggaataccattgaagagactggaaacttggctgaacaagcgcgtgcccatgtagagaacacagagcggttgattgaaatcgcatccagagaacttgagaaagcaaaagtcgctgctgccaatgtgtcagtcactcagccagaatctacaggggacccaaacaacatgactcttttggcagaagaggctcgaaagcttgctgaacgtcataaacaggaagctgatgacattgttcgagtggcaaagacagccaatgatacgtcaactgaggcatacaacctgcttctgaggacactggcaggagaaaatcaaacagcatttgagattgaagagcttaataggaagtatgaacaagcgaagaacatctcacaggatctggaaaaacaagctgcccgagtacatgaggaggccaaaagggccggtgacaaagctgtggagatctatgccagcgtggctcagctgagccctttggactctgagacactggagaatgaagcaaataacataaagatggaagctgagaatctggaacaactgattgaccagaaattaaaagattatgaggacctcagagaagatatgagagggaaggaacttgaagtcaagaaccttctggagaaaggcaagactgaacagcagaccgcagaccaactcctagcccgagctgatgctgccaaggccctcgctgaagaagctgcaaagaagggacgggataccttacaagaagctaatgacattctcaacaacctgaaagattttgataggcgcgtgaacgataacaagacggccgcagaggaggcactaaggaagattcctgccatcaaccagaccatcactgaagccaatgaaaagaccagagaagcccagcaggccctgggcagtgctgcggcggatgccacagaggccaagaacaaggcccatgaggcggagaggatcgcaagcgctgtccaaaagaatgccaccagcaccaaggcagaagctgaaagaacttttgcagaagttacagatctggataatgaggtgaacaatatgttgaagcaactgcaggaagcagaaaaagagctaaagagaaaacaagatgacgctgaccaggacatgatgatggcagggatggcttcacaggctgctcaagaagccgagatcaatgccagaaaagccaaaaactctgttactagcctcctcagcattattaatgacctcttggagcagctggggcagctggatacagtggacctgaataagctaaacgagattgaaggcaccctaaacaaagccaaagatgaaatgaaggtcagcgatcttgataggaaagtgtctgacctggagaatgaagccaagaagcaggaggctgccatcatggactataaccgagatatcgaggagatcatgaaggacattcgcaatctggaggacatcaggaagaccttaccatctggctgcttcaacaccccgtccattgaaaagccctagtgtctttagggctggaaggcagcatccctctgacaggggggcagttgtgaggccacagagtgccttgacacaaagattacatttttcagacccccactcctctgctgctgtccatcactgtccttttgaaccaggaaaagtcacagagtttaaagagaagcaaattaaacatcctgaatcgggaacaaagggttttatctaataaagtgtctcttcc

SEQ ID NO: 52 - DNA, 4620 bp, Homo sapiens
cgccctcgccgcccgcggcgccccgagcgctttgtgagcagatgcggagccgagtggagggcgcgagccagatgcggggcgacagctgacttgctgagaggaggcggggaggcgcggagcgcgcgtgtggtccttgcgccgctgacttctccactggttcctgggcaccgaaagataaacctctcataatgaaggcccccgctgtgcttgcacctggcatcctcgtgctcctgtttaccttggtgcagaggagcaatggggagtgtaaagaggcactagcaaagtccgagatgaatgtgaatatgaagtatcagcttcccaacttcaccgcggaaacacccatccagaatgtcattctacatgagcatcacattttccttggtgccactaactacatttatgttttaaatgaggaagaccttcagaaggttgctgagtacaagactgggcctgtgctggaacacccagattgtttcccatgtcaggactgcagcagcaaagccaatttatcaggaggtgtttggaaagataacatcaacatggctctagttgtcgacacctactatgatgatcaactcattagctgtggcagcgtcaacagagggacctgccagcgacatgtctttccccacaatcatactgctgacatacagtcggaggttcactgcatattctccccacagatagaagagcccagccagtgtcctgactgtgtggtgagcgccctgggagccaaagtcctttcatctgtaaaggaccggttcatcaacttctttgtaggcaataccataaattcttcttatttcccagatcatccattgcattcgatatcagtgagaaggctaaaggaaacgaaagatggttttatgtttttgacggaccagtcctacattgatgttttacctgagttcagagattcttaccccattaagtatgtccatgcctttgaaagcaacaattttatttacttcttgacggtccaaagggaaactctagatgctcagacttttcacacaagaataatcaggttctgttccataaactctggattgcattcctacatggaaatgcctctggagtgtattctcacagaaaagagaaaaaagagatccacaaagaaggaagtgtttaatatacttcaggctgcgtatgtcagcaagcctggggcccagcttgctagacaaataggagccagcctgaatgatgacattcttttcggggtgttcgcacaaagcaagccagattctgccgaaccaatggatcgatctgccatgtgtgcattccctatcaaatatgtcaacgacttcttcaacaagatcgtcaacaaaaacaatgtgagatgtctccagcatttttacggacccaatcatgagcactgctttaataggacacttctgagaaattcatcaggctgtgaagcgcgccgtgatgaatatcgaacagagtttaccacagctttgcagcgcgttgacttattcatgggtcaattcagcgaagtcctcttaacatctatatccaccttcattaaaggagacctcaccatagctaatcttgggacatcagagggtcgcttcatgcaggttgtggtttctcgatcaggaccatcaacccctcatgtgaattttctcctggactcccatccagtgtctccagaagtgattgtggagcatacattaaaccaaaatggctacacactggttatcactgggaagaagatcacgaagatcccattgaatggcttgggctgcagacatttccagtcctgcagtcaatgcctctctgccccaccctttgttcagtgtggctggtgccacgacaaatgtgtgcgatcggaggaatgcctgagcgggacatggactcaacagatctgtctgcctgcaatctacaaggttttcccaaatagtgcaccccttgaaggagggacaaggctgaccatatgtggctgggactttggatttcggaggaataataaatttgatttaaagaaaactagagttctccttggaaatgagagctgcaccttgactttaagtgagagcacgatgaatacattgaaatgcacagttggtcctgccatgaataagcatttcaatatgtccataattatttcaaatggccacgggacaacacaatacagtacattctcctatgtggatcctgtaataacaagtatttcgccgaaatacggtcctatggctggtggcactttacttactttaactggaaattacctaaacagtgggaattctagacacatttcaattggtggaaaaacatgtactttaaaaagtgtgtcaaacagtattcttgaatgttataccccagcccaaaccatttcaactgagtttgctgttaaattgaaaattgacttagccaaccgagagacaagcatcttcagttaccgtgaagatcccattgtctatgaaattcatccaaccaaatcttttattagtacttggtggaaagaacctctcaacattgtcagttttctattttgctttgccagtggtgggagcacaataacaggtgttgggaaaaacctgaattcagttagtgtcccgagaatggtcataaatgtgcatgaagcaggaaggaactttacagtggcatgtcaacatcgctctaattcagagataatctgttgtaccactccttccctgcaacagctgaatctgcaactccccctgaaaaccaaagcctttttcatgttagatgggatcctttccaaatactttgatctcatttatgtacataatcctgtgtttaagccttttgaaaagccagtgatgatctcaatgggcaatgaaaatgtactggaaattaagggaaatgatattgaccctgaagcagttaaaggtgaagtgttaaaagttggaaataagagctgtgagaatatacacttacattctgaagccgttttatgcacggtccccaatgacctgctgaaattgaacagcgagctaaatatagagtggaagcaagcaatttcttcaaccgtccttggaaaagtaatagttcaaccagatcagaatttcacaggattgattgctggtgttgtctcaatatcaacagcactgttattactacttgggtttttcctgtggctgaaaaagagaaagcaaattaaagatctgggcagtgaattagttcgctacgatgcaagagtacacactcctcatttggataggcttgtaagtgcccgaagtgtaagcccaactacagaaatggtttcaaatgaatctgtagactaccgagctacttttccagaagatcagtttcctaattcatctcagaacggttcatgccgacaagtgcagtatcctctgacagacatgtcccccatcctaactagtggggactctgatatatccagtccattactgcaaaatactgtccacattgacctcagtgctctaaatccagagctggtccaggcagtgcagcatgtagtgattgggcccagtagcctgattgtgcatttcaatgaagtcataggaagagggcattttggttgtgtatatcatgggactttgttggacaatgatggcaagaaaattcactgtgctgtgaaatccttgaacagaatcactgacataggagaagtttcccaatttctgaccgagggaatcatcatgaaagattttagtcatcccaatgtcctctcgctcctgggaatctgcctgcgaagtgaagggtctccgctggtggtcctaccatacatgaaacatggagatcttcgaaatttcattcgaaatgagactcataatccaactgtaaaagatcttattggctttggtcttcaagtagccaaagcgatgaaatatcttgcaagcaaaaagtttgtccacagagacttggctgcaagaaactgtatgctggatgaaaaattcacagtcaaggttgctgattttggtcttgccagagacatgtatgataaagaatactatagtgtacacaacaaaacaggtgcaaagctgccagtgaagtggatggctttggaaagtctgcaaactcaaaagtttaccaccaagtcagatgtgtggtcctttggcgtcgtcctctgggagctgatgacaagaggagccccaccttatcctgacgtaaacacctttgatataactgtttacttgttgcaagggagaagactcctacaacccgaatactgcccagaccccttatatgaagtaatgctaaaatgctggcaccctaaagccgaaatgcgcccatccttttctgaactggtgtcccggatatcagcgatcttctctactttcattggggagcactatgtccatgtgaacgctacttatgtgaacgtaaaatgtgtcgctccgtatccttctctgttgtcatcagaagataacgctgatgatgaggtggacacacgaccagcctccttctgggagacatcatagtgctagtactatgtcaaagcaacagtccacactttgtccaatggttttttcactgcctgacctttaaaaggccatcgatattctttgctccttgccataggacttgtattgttatttaaattactggattctaaggaatttcttatctgacagagcatcagaaccagaggcttggtcccacaggccagggaccaatgcgctgcag

SEQ ID NO: 53 - DNA, 3879 bp, Homo sapiens
ggcacgaggccagccgaatccaagccgtgtgtactgcgtgctcagcactgcccgacagtcctagctaaacttcgccaactccgctgcctttgccgccaccatgcccaaaacgatcagtgtgcgtgtgaccaccatggatgcagagctggagtttgccatccagcccaacaccaccgggaagcagctatttgaccaggtggtgaaaactattggcttgagggaagtttggttctttggtctgcagtaccaggacactaaaggtttctccacctggctgaaactcaataagaaggtgactgcccaggatgtgcggaaggaaagccccctgctctttaagttccgtgccaagttctaccctgaggatgtgtccgaggaattgattcaggacatcactcagcgcctgttctttctgcaagtgaaagagggcattctcaatgatgatatttactgcccgcctgagaccgctgtgctgctggcctcgtatgctgtccagtctaagtatggcgacttcaataaggaagtgcataagtctggctacctggccggagacaagttgctcccgcagagagtcctggaacagcacaaactcaacaaggaccagtgggaggagcggatccaggtgtggcatgaggaacaccgtggcatgctcagggaggatgctgtcctggaatatctgaagattgctcaagatctggagatgtatggtgtgaactacttcagcatcaagaacaagaaaggctcagagctgtggctgggggtggatgccctgggtctcaacatctatgagcagaatgacagactaactcccaagataggcttcccctggagtgaaatcaggaacatctctttcaatgataagaaatttgtcatcaagcccattgacaaaaaagccccggacttcgtcttctatgctccccggctgcggattaacaagcggatcttggccttgtgcatggggaaccatgaactatacatgcgccgtcgcaagcctgataccattgaggtgcagcagatgaaggcacaggcccgggaggagaagcaccagaagcagatggagcgtgctatgctggaaaatgagaagaagaagcgtgaaatggcagagaaggagaaagagaagattgaacgggagaaggaggagctgatggagaggctgaagcagatcgaggaacagactaagaaggctcagcaagaactggaagaacagacccgtagggctctggaacttgagcaggaacggaagcgtgcccagagcgaggctgaaaagctggccaaggagcgtcaagaagctgaagaggccaaggaggccttgctgcaggcctcccgggaccagaaaaagactcaggaacagctggccttggaaatggcagagctgacagctcgaatctcccagctggagatggcccgacagaagaaggagagtgaggctgtggagtggcagcagaaggcccagatggtacaggaagacttggagaagacccgtgctgagctgaagactgccatgagtacacctcatgtggcagagcctgctgagaatgagcaggatgagcaggatgagaatggggcagaggctagtgctgacctacgggctgatgctatggccaaggaccgcagtgaggaggaacgtaccactgaggcagagaagaatgagcgtgtgcagaagcacctgaaggccctcacttcggagctggccaatgccagagatgagtccaagaagactgccaatgacatgatccatgctgagaacatgcgactgggccgagacaaatacaagaccctgcgccagatccggcagggcaacaccaagcagcgcattgacgaatttgagtctatgtaatgggcacccagcctctagggacccctcctccctttttccttgtccccacactcctacacctaactcacctaactcatactgtgctggagccactaactagagcagccctggagtcatgccaagcatttaatgtagccatgggaccaaacctagccccttagcccccacccacttccctgggcaaatgaatggctcactatggtgccaatggaacctcctttctcttctctgttccattgaatctgtatggctagaatatcctacttctccagcctagaggtactttccacttgattttgcaaatgcccttacacttactgttgtcctatgggagtcaagtgtggagtaggttggaagctagctcccctcctctcccctccactgtcttcttcaggtcctgagattacacggtggagtgtatgcggtctaggaatgagacaggacctagatatcttctccagggatgtcaactgacctaaaatttgccctcccatcccgtttagagttatttaggctttgtaacgattgggggaataaaaagatgttcagtcatttttgtttctacctcccagatcggatctgttgcaaactcagcctcaataagccttgtcgttgactttagggactcaatttctccccagggtggatgggggaaatggtgccttcaagaccttcaccaaacatactagaagggcattggccattctattgtggcaaggctgagtagaagatcctaccccaattccttgtaggagtataggccggtctaaagtgagctctatgggcagatctaccccttacttattattccagatctgcagtcacttcgtgggatctgcccctccctgcttcaatacccaaatcctctccagctataacagtagggatgagtacccaaaagctcagccagccccatcaggactcttgtgaaaagagaggatatgttcacacctagcgtcagtattttccctgctaggggttttaggtctcttcccctctcagagctacttgggccatagctcctgctccacagccatcccagccttggcatctagagcttgatgccagtaggctcaactagggagtgagtgcaaaaagctgagtatggtgagagaagcctgtgccctgatccaagtttactcaaccctctcaggtgaccaaaatccccttctcatcactcccctcaaagaggtgactgggccctgcctctgtttgacaaacctctaacccaggtcttgacaccagctgttctgtcccttggagctgtaaaccagagagctgctgggggattctggcctagtcccttccacacccccaccccttgctctcaacccaggagcatccacctccttctctgtctcatgtgtgctcttcttctttctacagtattatgtactctactgatatctaaatattgatttctgccttccttgctaatgcaccattagaagatattagtcttggggcaggatgattttggcctcattactttaccacccccacacctggaaagcatatactatattacaaaatgacattttgccaaaattattaatataagaagctttcagtattagtgatgtcatctgtcactataggtcatacaatccattcttaaagtacttgttatttgtttttattattactgtttgtcttctccccagggttcagtccctcaaggggccatcctgtcccaccatgcagtgccccctagcttagagcctccctcaattccccctggccaccaccccccactctgtgcctgaccttgaggagtcttgtgtgcattgctgtgaattagctcacttggtgatatgtcctatattggctaaattgaaacctggaattgtggggcaatctattaatagctgccttaaagtcagtaacttacccttagggaggctgggggaaaaggttagattttgtattcaggggttttttgtgtactttttgggtttttaaaaaattgtttttggaggggtttatgctcaatccatgttctatttcagtgccaataaaatttaggtgacttcaaaaaaaaaaaa

SEQ ID NO: 54 - DNA, 7787 bp, Homo sapiens
gagacaaaggctgccgtcgggacgggcgagttagggacttgggtttgggcgaacaaaaggtgagaaggacaagaagggaccgggcgatggcagcaggggagccccgcgggcgcgcgtcctcgggagtggcgccgtgacacgcatggtttccccggacccgcggcggcgctgacttccgcgagtcggagcggcactcggcgagtccgggactgcgctggaacaatggataacttcttcaccgagggaacacgggtctggctgagagaaaatggccagcattttccaagtactgtaaattcctgtgcagaaggcatcgtcgtcttccggacagactatggtcaggtattcacttacaagcagagcacaattacccaccagaaggtgactgctatgcaccccacgaacgaggagggcgtggatgacatggcgtccttgacagagctccatggcggctccatcatgtataacttattccagcggtataagagaaatcaaatatatacctacatcggctccatcctggcctccgtgaacccctaccagcccatcgccgggctgtacgagcctgccaccatggagcagtacagccggcgccacctgggcgagctgcccccgcacatcttcgccatcgccaacgagtgctaccgctgcctgtggaagcgctacgacaaccagtgcatcctcatcagtggtgaaagtggggcaggtaaaaccgaaagcactaaattgatcctcaagtttctgtcagtcatcagtcaacagtctttggaattgtccttaaaggagaagacatcctgtgttgaacgagctattcttgaaagcagccccatcatggaagctttcggcaatgcgaagaccgtgtacaacaacaactctagtcgctttgggaagtttgttcagctgaacatctgtcagaaaggaaatattcagggcgggagaattgtagattatttattagaaaaaaaccgagtagtaaggcaaaatcccggggaaaggaattatcacatattttatgcactgctggcagggctggaacatgaagaaagagaagaattttatttatctacgccagaaaactaccactacttgaatcagtctggatgtgtagaagacaagacaatcagtgaccaggaatcctttagggaagttattacggcaatggacgtgatgcagttcagcaaggaggaagttcgggaagtgtcgaggctgcttgctggtatactgcatcttgggaacatagaatttatcactgctggtggggcacaggtttccttcaaaacagctttgggcagatctgcggagttacttgggctggacccaacacagctcacagatgctttgacccagagatcaatgttcctcaggggagaagagatcctcacgcctctcaatgttcaacaggcagtagacagcagggactccctggccatggctctgtatgcgtgctgctttgagtgggtaatcaagaagatcaacagcaggatcaaaggcaatgaggacttcaagtctattggcatcctcgacatctttggatttgaaaactttgaggttaatcactttgaacagttcaatataaactatgcaaacgagaaacttcaggagtacttcaacaagcatattttttctttagaacaactagaatatagccgggaaggattagtgtgggaagatattgactggatagacaatggagaatgcctggacttgattgagaagaaacttggcctcctagcccttatcaatgaagaaagccattttcctcaagccacagacagcaccttattggagaagctacacagtcagcatgcgaataaccacttttatgtgaagcccagagttgcagttaacaattttggagtgaagcactatgctggagaggtgcaatatgatgtccgaggtatcttggagaagaacagagatacatttcgagatgaccttctcaatttgctaagagaaagccgatttgactttatctacgatctttttgaacatgtttcaagccgcaacaaccaggataccttgaaatgtggaagcaaacatcggcggcctacagtcagctcacagttcaaggactcactgcattccttaatggcaacgctaagctcctctaatcctttctttgttcgctgtatcaagccaaacatgcagaagatgccagaccagtttgaccaggcggttgtgctgaaccagctgcggtactcagggatgctggagactgtgagaatccgcaaagctgggtatgcggtccgaagaccctttcaggacttttacaaaaggtataaagtgctgatgaggaatctggctctgcctgaggacgtccgagggaagtgcacgagcctgctgcagctctatgatgcctccaacagcgagtggcagctggggaagaccaaggtctttcttcgagaatccttggaacagaaactggagaagcggagggaagaggaagtgagccacgcggccatggtgattcgggcccatgtcttgggcttcttagcacgaaaacaatacagaaaggtcctttattgtgtggtgataatacagaagaattacagagcattccttctgaggaggagatttttgcacctgaaaaaggcagccatagttttccagaagcaactcagaggtcagattgctcggagagtttacagacaattgctggcagagaaaagggagcaagaagaaaagaagaaacaggaagaggaagaaaagaagaaacgggaggaagaagaaagagaaagagagagagagcgaagagaagccgagctccgcgcccagcaggaagaagaaacgaggaagcagcaagaactcgaagccttgcagaagagccagaaggaagctgaactgacccgtgaactggagaaacagaaggaaaataagcaggtggaagagatcctccgtctggagaaagaaatcgaggacctgcagcgcatgaaggagcagcaggagctgtcgctgaccgaggcttccctgcagaagctgcaggagcggcgggaccaggagctccgcaggctggaggaggaagcgtgcagggcggcccaggagttcctcgagtccctcaatttcgacgagatcgacgagtgtgtccggaatatcgagcggtccctgtcggtgggaagcgaattttccagcgagctggctgagagcgcatgcgaggagaagcccaacttcaacttcagccagccctacccagaggaggaggtcgatgagggcttcgaagccgacgacgacgccttcaaggactcccccaaccccagcgagcacggccactcagaccagcgaacaagtggcatccggaccagcgatgactcttcagaggaggacccatacatgaacgacacggtggtgcccaccagccccagtgcggacagcacggtgctgctcgccccatcagtgcaggactccgggagcctacacaactcctccagcggcgagtccacctactgcatgccccagaacgctggggacttgccctccccagacggcgactacgactacgaccaggatgactatgaggacggtgccatcacttccggcagcagcgtgaccttctccaactcctacggcagccagtggtcccccgactaccgctgctctgtggggacctacaacagctcgggtgcctaccggttcagctctgagggggcgcagtcctcgtttgaagatagtgaagaggactttgattccaggtttgatacagatgatgagctttcataccggcgtgactctgtgtacagctgtgtcactctgccgtatttccacagctttctgtacatgaaaggtggcctgatgaactcttggaaacgccgctggtgcgtcctcaaggatgaaaccttcttgtggttccgctccaagcaggaggccctcaagcaaggctggctccacaaaaaaggggggggctcctccacgctgtccaggagaaattggaagaagcgctggtttgtcctccgccagtccaagctgatgtactttgaaaacgacagcgaggagaagctcaagggcaccgtagaagtgcgaacggcaaaagagatcatagataacaccaccaaggagaatgggatcgacatcattatggccgataggactttccacctgattgcagagtccccagaagatgccagccagtggttcagcgtgctgagtcaggtccacgcgtccacggaccaggagatccaggagatgcatgatgagcaggcaaacccacagaatgctgtgggcaccttggatgtggggctgattgattctgtgtgtgcctctgacagccctgatagacccaactcgtttgtgatcatcacggccaaccgggtgctgcactgcaacgccgacacgccggaggagatgcaccactggataaccctgctgcagaggtccaaaggggacaccagagtggagggccaggaattcatcgtgagaggatggttgcacaaagaggtgaagaacagtccgaagatgtcttcactgaaactgaagaaacggtggtttgtactcacccacaattccctggattactacaagagttcagagaagaacgcgctcaaactggggaccctggtcctcaacagcctctgctctgtcgtccccccagatgagaagatattcaaagagacaggctactggaacgtcaccgtgtacgggcgcaagcactgttaccggctctacaccaagctgctcaacgaggccacccggtggtccagtgccattcaaaacgtgactgacaccaaggccccgatcgacacccccacccagcagctgattcaagatatcaaggagaactgcctgaactcggatgtggtggaacagatttacaagcggaacccgatccttcgatacacccatcaccccttgcactccccgctcctgccccttccgtatggggacataaatctcaacttgctcaaagacaaaggctataccacccttcaggatgaggccatcaagatattcaattccctgcagcaactggagtccatgtctgacccaattccaataatccagggcatcctacagacagggcatgacctgcgacctctgcgggacgagctgtactgccagcttatcaaacagaccaacaaagtgccccaccccggcagtgtgggcaacctgtacagctggcagatcctgacatgcctgagctgcaccttcctgccgagtcgagggattctcaagtatctcaagttccatctgaaaaggatacgggaacagtttccaggaaccgagatggaaaaatacgctctcttcacttacgaatctcttaagaaaaccaaatgccgagagtttgtgccttcccgagatgaaatagaagctctgatccacaggcaggaaatgacatccacggtctattgccatggcggcggctcctgcaagatcaccatcaactcccacaccactgctggggaggtggtggagaagctgatccgaggcctggccatggaggacagcaggaacatgtttgctttgtttgaatacaacggccacgtcgacaaagccattgaaagtcgaaccgtcgtagctgatgtcttagccaagtttgaaaagctggctgccacatccgaggttggggacctgccatggaaattctacttcaaactttactgcttcctggacacagacaacgtgccaaaagacagtgtggagtttgcatttatgtttgaacaggcccacgaagcggttatccatggccaccatccagccccggaagaaaacctccaggttcttgctgccctgcgactccagtatctgcagggggattatactctgcacgctgccatcccacctctcgaagaggtttattccctgcagagactcaaggcccgcatcagccagtcaaccaaaaccttcaccccttgtgaacggctggagaagaggcggacgagcttcctagaggggaccctgaggcggagcttccggacaggatccgtggtccggcagaaggtcgaggaggagcagatgctggacatgtggattaaggaagaagtctcctctgctcgagccagtatcattgacaagtggaggaaatttcagggaatgaaccaggaacaggccatggccaagtacatggccttgatcaaggagtggcctggctatggctcgacgctgtttgatgtggagtgcaaggaaggtggcttccctcaggaactctggttgggtgtcagcgcggacgccgtctccgtctacaagcgtggagagggaagaccactggaagtcttccagtatgaacacatcctctcttttggggcacccctggcgaatacgtataagatcgtggtcgatgagagggagctgctctttgaaaccagtgaggtggtggatgtggccaagctcatgaaagcctacatcagcatgatcgtgaagaagcgctacagcacgacacgctccgccagcagccagggcagctccaggtgaaggcgggacagagcccacctgtctttgctacctgaacgcaccaccctctggcctaggctggctccagtgtgccatgcccagccaaaacaaacacagagctgcccaggctttctggaagcttctggtctgagggaggtgtctccgaggatccttttgcctgccgccttcattgatcctgtattaagctgtcaactttaacagtctgcacagtttccaaagctttactactcttagaggacacatgccttaaaaaaggaggggaggaaccacgctgccaccaaagcagccggaagtgccttaacttgtggaaccaacactaatcgaccgtaactgtgctactgaagggaactgcctttcccccttctgggggagacttaacagagcgtggaaggggggcattctctgtcaatgatgcactaacctcccaacctgatttccccgaatctgagggaaggtgagggagtgggaagggggatggagagctcgaggggacagtgtgtttgagctggagtgctgcgggcagcctttctcatggaatgacatgaatcaacttttttctttgtttcatcttttaagtgtacgtgcttgcctgttcgtgcatgtgttcataaactcaacactttaatcatggtttcatgagcattaaaaagcaaagggaaaaaggatgtgtaatggtgtacacagtctgtatattttaataatgcagagctatagtctcaattgttactttataaggtggttttattaacaaacccaaatcctggattttcctgtctttgctgtattttgaaaaacacgtgttgactccattgttttacatgtagcaaagtctgccatctgtgtctgctgtattataaacagataagcagcctacaagataactgtatttataaaccactcttcaacagctggctccagtgctggttttagaacaagaatgaagtcattttggagtctttcatgtctaaaagatttaagttaaaaacaaagtgttacttggaaggttagcttctatcattctggatagattacagatataataaccatgttgactatgggggagagacgctgcattccagaaacgtcttaacacttgagtgaatcttcaaaggaccctgacattaaatgctgaggctttaatacacacatattttatcccaagtttataatggtggtctgaacaaggcacctgtaaataaatcagcatttatgaccagaagaaaaataatctggtcttggactttttatttttatatggaaaagttttaaggacttgggccaactaagtctacccacacgaaaaaagaaatttgccttgtccctttgtgtacaaccatgcaaaactgtttgttggctcacagaagttctgacaataaaagatactagct

SEQ ID NO: 55 - DNA, 520 bp, Homo sapiens
ttcatgttttcccaaagaatcctgtattttaatgaatagctgaataaatagacattaattatgaaattcacattaagatagaagaaaatccaaacattctgattgctttatctcttaaatttgataactactacaaaacatactatttatgttagggtaaaaataagctgactcacaggagtgtaactgggaagtgctggcagatatatacagtaacatggaggagccatacaacaaaagcgtttatatgtacatcattttttttcctttttgtttggagaaatgctgccttataaaatcggaaaacacacagtagactacatgcaacaaggaccaatacaatgtgcacagcagaagaatcaaataagacacaagaactatgggtttaaaaaagaatttgggagcaggacaaaaaacaaggattgaaacctggaatgctttcttattgaggtttcagaatataaatttgtctaacaagcctcttgatagttttcaaaagttcccactcaaccacctatgg

SEQ ID NO: 56 - DNA, 2320 bp, Homo sapiens
gggccggccgcccctccgccagccaagtccgccgctctgacccccggcagcaagtcgccaccatggtgaagatcgtgacagttaagacccaggcgtaccaggaccagaagccgggcacgagcgggctgcggaagcgggtgaaggtgttccagagcagcgccaactacgcggagaacttcatccagagtatcatctccaccgtggagccggcgcagcggcaggaggccacgctggtggtgggcggggacggccggttctacatgaaggaggccatccagctcatcgctcgcatcgctgccgccaacgggatcggtcgcttggttatcggacagaatggaatcctctccacccctgctgtatcctgcatcattagaaaaatcaaagccattggtgggatcattctgacagccagtcacaacccagggggccccaatggagattttggaatcaaattcaatatttctaatggaggtcctgctccagaagcaataactgataaaattttccaaatcagcaagacaattgaagaatatgcagtttgccctgacctgaaagtagaccttggtgttctgggaaagcagcagtttgacttggaaaataagttcaaacccttcacagtggaaattgtggattcggtagaagcttatgctacaatgctgagaagcatctttgatttcagtgcactgaaagaactactttctgggccaaaccgactgaagatctgtattgatgctatgcatggagttgtgggaccgtatgtaaagaagatcctctgtgaagaactcggtgcccctgcgaactcggcagttaactgcgttcctctggaggactttggaggccaccaccctgaccccaacctcacctatgcagctgacctggtggagaccatgaagtcaggagagcatgattttggggctgcctttgatggagatggggatcgaaacatgattctgggcaagcatgggttctttgtgaacccttcagactctgtggctgtcattgctgccaacatcttcagcattccgtatttccagcagactggggtccgcggctttgcacggagcatgcccacgagtggtgctctggaccgggtggctagtgctacaaagattgctttgtatgagaccccaactggctggaagttttttgggaatttgatggacgcgagcaaactgtccctttgtggggaggagagcttcgggaccggttctgaccacatccgtgagaaagatggactgtgggctgtccttgcctggctctccatcctagccacccgcaagcagagtgtggaggacattctcaaagatcattggcaaaagcatggccggaatttcttcaccaggtatgattacgaggaggtggaagctgagggcgcaaacaaaatgatgaaggacttggaggccctgatgtttgatcgctcctttgtggggaagcagttctcagcaaatgacaaagtttacactgtggagaaggccgataactttgaatacagcgacccagtggatggaagcatttcaagaaatcagggcttgcgcctcattttcacagatggttctcgaatcgtcttccgactgagcggcactgggagtgccggggccaccattcggctgtacatcgatagctatgagaaggacgttgccaagattaaccaggacccccaggtcatgttggccccccttatttccattgctctgaaagtgtcccagctgcaggagaggacgggacgcactgcacccactgtcatcacctaagaagacaggcctgatgtggtacgtccctccacccccggacccatccaagtcatctgattgaagagcatgacagaaacaaaatgtattcaccaagcattttaggatttgactttttcactaaccagttgacgagcagtgcatttacaaggcactgccaaacaagatgcccttgggagctgtgagggaaagaggacctgcgggcttagatcaatctcaattccttttcatgccctcctgcattgctgctgcgtgggtatttgtctccttagccatcaggtacagtttacactacaatgtaagctataggtggagcatcagcagtgagtgaggccattcttcatccttaggatgtggcaatgaaatgatggtgcaagttcctttctcttttgtgaatctttccccccatttcctgtttacatgtaacccaacaaaatgcaatttctagtgccttctgtccaatcagttctttcctctgagtgagacgtacttggctacagatttctgccttgttttgcgacattgtcccattcacacagatattttgggataataaaggaaaataagctaca

SEQ ID NO: 57 - DNA, 2876 bp, Homo sapiens
gagcggcccgaggaggacgcagcggcgctggagctttcgtcggacgaggcggtggaggttgaggaggttattgaggagtcccgcgcagagcgtatcaagcgcagcggcctgcggcgcgtggacgacttcaagaaggccttctccaaggagaagatggagaagaccaaggtgcgtacccgcgagaacctggagaagacgcgcctcaagaccaaggaaaacctggagaagacgcggcacaccctggagaagcgcatgaacaagctgggcacgcgcctggtgcccgccgagcggcgcgagaaactgaagacgtcgcgggacaagttgcgcaaatccttcacgcccgaccacgtggtgtacgcgcgctccaagaccgcggtctacaaggtgccacccttcaccttccacgtcaagaagatccgcgagggccaggtggaagtgctcaaggccaccgagatggtggaggtgggcgccgacgacgacgagggcggcgcggagcgcggggaggccggcgacctgcggcgcgggagcagccccgacgtgcacgcgctgctggagatcaccgaggagtcggacgccgtgctggtggacaagagcgacagcgactgagccgcccccgctgccacccaccccattcctcgctccttccgaacttcctctttcgcattctctctcggctcgagctggctgagatttttctaaattgaaaacacgcccccctccccacacctccaggaactccactcccagtcttagagctgttaggacccgatggggaggcagcccccgcagtggacagcccccgcttggacacagtccgagtggaatgggaagggaatggtcaatccctgtcctggttgtccaagtcgggatctcagaggaaattgcagtgattccacggttaggcccccctgggggggctgccttcccctcagcctctccccacaccacccacccagctgctgtcattccgctcactgagctcttcttcattctcaccctgatccctgggggactcaaagccaaaactgcccaaagaggaaagattgaatcctaaaggggatccttgcccccatgggaggccccctactagaaggacgtgaaagcagcttttgggggaaactgaggcagtggggaagacagagcagaatgagccctcaccctggctgggggtccagcacaggctgtatctgcagagggtcccagaggaacgctggagccaagagaagccctgggaaggaggggtggggaacgacatgcatgtgagggatggcacactgatgtgtttatgcacctgtacacaggagcgcatggccatggctttggaaaggagaatggaaaaatagaagaaggtcggccgggcttggtggcttaagcctgtaaccccagcactttgggaggccgaggtgggcggatcacctgaggtcaggagttcgggaccagcctggcaaacaccccatctctactaagcgaaaacccatctctactaaaattacaaaaattagctgggcatggttgcgcatgcctgtaatcccagctactttggaggctgaggtggggagaattgcttgaacctgggaggtggaggttgcagtgagccaaggtcgcgacactgcactccagcctgggtgacagagtgagactccatctcaacagaaggaaaaaaaaaggaaaataggagaaggtggaaatgggtgaagagagaagtcccctcactagctgcatgagaaatctatcttactgtggttctccatgggcagcaggaccatttttcagaatcaagagggaggacagtgtgagaaggcgatgatccaaagaagacagagaggtcagccccacccgatccctcaaatgggctcttggaggcacccccaggggcagcccatttctcaaagtccagaaaattagggtcccagaagggggcagcagcaggctgggagttaggagggagagcagggtgccggccctgccaccaagttgagagctggaggggaggtggggagagaacatcacagagcagccagccctggttcactcctggcagtttcttctcaagctccttccctaggagcatggtggcacgtgcctgtggtctcagctacttgggaggctgaggcgggaggatcgccagagcccaggagtttgaggctgcagtgagctatgagggtgcctctgtgctccatcctaggcaacagagtgagacgctgtttaaaaaggaaaaaatccttccctagagctagtatcctaaagctgcagagctagcccagacctcattggtttccttgtccttggggtgcttttcctgaatctttgggggtgaagggagtgttgctcccagtccagaggcctgattctgttcggactgggttctcaagacacgaccaggttctcaagacacgagtccccttgttcctccccattaaagggggtttgtcagaagcaagaacagcccctctccccagtcacagcctgaagggaggccccgagagcttcctccttccccccacctgctccttaccttctctgccctgctttttagaactgcagttcattgttttaagggattgggggagggagcctggggacacaaaccttttatacaatacaaagctttgctttttttttttttttcttccttttccctttctcggttctcttctctcctctgaatggctgaagacccctctgccgagggaggttggggattgtgggacaaggtcccttggtgctgatggcctgaaggggcctgagctgtgggcagatgcagttttctgtgggcttggggaacctctcacgttgctgtgtcctggtgagcagcccgaccaataaacctgcttttctaaaaaaaaaaaaaaaaaaaaaaaaaaaaaaaaaaaaaa

SEQ ID NO: 58 - DNA, 3007 bp, Homo sapiens
gcccggagagccgcatctattggcagctttgttattgatcagaaactgctcgccgccgacttggcttccagtctggctgcgggcaacccttgagttttcgcctctgtcctgtcccccgaactgacaggtgctcccagcaacttgctggggacttctcgccgctcccccgcgtccccaccccctcattcctccctcgccttcacccccacccccaccacttcgccacagctcaggatttgtttaaaccttgggaaactggttcaggtccaggttttgctttgatccttttcaaaaactggagacacagaagagggctctaggaaaaagttttggatgggattatgtggaaactaccctgcgattctctgctgccagagcaggctcggcgcttccaccccagtgcagccttcccctggcggtggtgaaagagactcgggagtcgctgcttccaaagtgcccgccgtgagtgagctctcaccccagtcagccaaatgagcctcttcgggcttctcctgctgacatctgccctggccggccagagacaggggactcaggcggaatccaacctgagtagtaaattccagttttccagcaacaaggaacagaacggagtacaagatcctcagcatgagagaattattactgtgtctactaatggaagtattcacagcccaaggtttcctcatacttatccaagaaatacggtcttggtatggagattagtagcagtagaggaaaatgtatggatacaacttacgtttgatgaaagatttgggcttgaagacccagaagatgacatatgcaagtatgattttgtagaagttgaggaacccagtgatggaactatattagggcgctggtgtggttctggtactgtaccaggaaaacagatttctaaaggaaatcaaattaggataagatttgtatctgatgaatattttccttctgaaccagggttctgcatccactacaacattgtcatgccacaattcacagaagctgtgagtccttcagtgctacccccttcagctttgccactggacctgcttaataatgctataactgcctttagtaccttggaagaccttattcgatatcttgaaccagagagatggcagttggacttagaagatctatataggccaacttggcaacttcttggcaaggcttttgtttttggaagaaaatccagagtggtggatctgaaccttctaacagaggaggtaagattatacagctgcacacctcgtaacttctcagtgtccataagggaagaactaaagagaaccgataccattttctggccaggttgtctcctggttaaacgctgtggtgggaactgtgcctgttgtctccacaattgcaatgaatgtcaatgtgtcccaagcaaagttactaaaaaataccacgaggtccttcagttgagaccaaagaccggtgtcaggggattgcacaaatcactcaccgacgtggccctggagcaccatgaggagtgtgactgtgtgtgcagagggagcacaggaggatagccgcatcaccaccagcagctcttgcccagagctgtgcagtgcagtggctgattctattagagaacgtatgcgttatctccatccttaatctcagttgtttgcttcaaggacctttcatcttcaggatttacagtgcattctgaaagaggagacatcaaacagaattaggagttgtgcaacagctcttttgagaggaggcctaaaggacaggagaaaaggtcttcaatcgtggaaagaaaattaaatgttgtattaaatagatcaccagctagtttcagagttaccatgtacgtattccactagctgggttctgtatttcagttctttcgatacggcttagggtaatgtcagtacaggaaaaaaactgtgcaagtgagcacctgattccgttgccttgcttaactctaaagctccatgtcctgggcctaaaatcgtataaaatctggatttttttttttttttttgctcatattcacatatgtaaaccagaacattctatgtactacaaacctggtttttaaaaaggaactatgttgctatgaattaaacttgtgtcgtgctgataggacagactggatttttcatatttcttattaaaatttctgccatttagaagaagagaactacattcatggtttggaagagataaacctgaaaagaagagtggccttatcttcactttatcgataagtcagtttatttgtttcattgtgtacatttttatattctccttttgacattataactgttggcttttctaatcttgttaaatatatctatttttaccaaaggtatttaatattcttttttatgacaacttagatcaactatttttagcttggtaaatttttctaaacacaattgttatagccagaggaacaaagatgatataaaatattgttgctctgacaaaaatacatgtatttcattctcgtatggtgctagagttagattaatctgcattttaaaaaactgaattggaatagaattggtaagttgcaaagactttttgaaaataattaaattatcatatcttccattcctgttattggagatgaaaataaaaagcaacttatgaaagtagacattcagatccagccattactaacctattccttttttggggaaatctgagcctagctcagaaaaacataaagcaccttgaaaaagacttggcagcttcctgataaagcgtgctgtgctgtgcagtaggaacacatcctatttattgtgatgttgtggttttattatcttaaactctgttccatacacttgtataaatacatggatatttttatgtacagaagtatgtctcttaaccagttcacttattgtactctggcaatttaaaagaaaatcagtaaaatattttgcttgtaaaatgcttaatatcgtgcctaggttatgtggtgactatttgaatcaaaaatgtattgaatcatcaaataaaagaatgtggctattttggggagaaaatt

SEQ ID NO: 59 - DNA, 5238 bp, Homo sapiens
gctgtggctgcggctgcggctgcggctgagatttggccgggcgtccgcaggccgtgggggatgggggcagcgagctccagccctcggcggtggcggcggccgtaggtgtggggcgggcgtccgcgtccggcacgcgagatggagcgccgtggatttcagtttttctgactgttacatgaaaggatgattgctcacaaacagaaaaagacaaagaaaaaacgtgcttgggcatcaggtcaactctctactgatattacaacttctgaaatggggctcaagtccttaagttccaactctatttttgatccggattacatcaaggagttggtgaatgatatcaggaagttctcccacatcttactatatttgaaagaagccatattttcagactgttttaaagaagttattcatatacgtctagaggaactgctccgtgttttaaagtctataatgaataaacatcagaacctcaattctgttgatcttcaaaatgctgcagaaatgctcactgcaaaagtgaaagctgtgaacttcacagaagttaatgaagaaaacaaaaacgatctcttccaggaagtgttttcttctattgaaactttggcatttacctttggaaatatccttacaaacttccttatgggagatgtaggcaatgattcattcttgcgactgcctgtttctcgagaaactaagtcgtttgaaaatgtttctgtggaatcagtggactcatccagtgaaaaaggaaatttttcccctttagaactagacaacgtgctgttaaagaacactgactctatcgagctggctttgtcatatgctaaaacttggtcaaaatatactaagaacatagtttcatgggttgaaaaaaagcttaacttggaattggagtccactagaaatatggtcaagttggcagaggcaactagaactaacattggaattcaggagttcatgccactgcagtctctgtttactaatgctcttcttaatgatatagaaagcagtcaccttttacaacaaacaattgcagctctccaggctaacaaatttgtgcagcctctacttggaaggaaaaatgaaatggaaaaacaaaggaaagaaataaaagagctttggaaacaggagcaaaataaaatgcttgaagcagagaatgctctcaaaaaggcaaaattattatgcatgcaacgtcaagatgaatatgagaaagcaaagtcttccatgtttcgtgcagaagaggagcatctgtcttcaagtggcggattagcaaaaaatctcaacaagcaactagaaaaaaagcgaaggttggaagaggaggctctccaaaaagtagaagaagcagatgaactttacaaagtttgtgtgacaaatgttgaagaaagaagaaatgatgtagaaaataccaaaagagaaattttagcacaactccggacacttgttttccagtgtgatcttacccttaaagcggtaacagttaacctcttccacatgcagcatctgcaggctgcttcccttgcagacagattacagtctctctgtggtagtgccaaactctatgacccaggccaagagtacagtgaatttgtcaaggccacaaattcaactgaagaagaaaaagttgatggaaatgtaaataaacatttaaatagttcccaaccttcaggatttggacctgccaactctttagaggatgttgtacgccttcctgacagttctaataaaattgaagaggacagatgctctaacagtgcagatataacaggtccttcctttataagatcatggacatttgggatgtttagtgattctgagagcactggagggagcagcgaatctagatctctggattcagaatctataagtccaggagactttcatcgaaaacttccacgaacaccatccagtggaactatgtcctctgcagatgatctagatgaaagagagccaccttccccttcagaaactggacccaattcccttggaacatttaagaaaacattgatgtcaaaggcagctctcacacacaagtttcgcaaattgagatcccccacgaaatgtagggattgtgaaggcattgtagtgttccaaggtgttgaatgtgaagagtgtctccttgtttgtcatcgaaagtgtttggaaaatttagtcattatttgtggtcatcagaaacttccaggaaaaatacacttatttggagcagaattcacactagttgcaaaaaaggaaccagatggtatcccttttatactcaaaatatgtgcctcagagattgaaaatagagctttgtgtctacagggaatttatcgtgtgtgtggaaacaaaataaaaactgaaaaattgtgtctagctttggaaaatggtatgcacttggtagatatttcagaatttagttcacatgatatctgtgacgtcttgaaattataccttcggcagctcccagaaccatttattttatttcgattgtacaaggaatttatagaccttgcaaaagagatccaacatgtaaatgaagaacaagagacaaaaaagaatagtcttgaagacaaaaaatggccaaatatgtgtatagaaataaaccgaattcttctaaaaagcaaagaccttctaagacaattgccagcatcaaattttaacagtcttcatttccttatagtacatctaaagcgggtagtagatcatgcagaagaaaacaagatgaactccaaaaacttgggggtgatatttggaccaagtctcattaggccaaggccacaaactgctcctatcaccatctcctcccttgcagagtattcaaatcaagcacgcttggtagagtttctcattacttactcacagaagatcttcgatgggtccctacaaccacaagatgttatgtgtagcataggtgttgttgatcaaggctgttttccaaagcctctgttatcaccagaagaaagagacattgaacgttccatgaagtcactatttttttcttcaaaggaagatatccatacttcagagagtgaaagcaaaatttttgaacgagctacatcatttgaggaatcagaacgcaagcaaaatgcgttaggaaaatgtgatgcatgtctcagtgacaaagcacagttgcttctagaccaagaggctgaatcagcatcccaaaagatagaagatggtaaagcccctaagccactttctctgaaatctgataggtcaacaaacaatgtggagaggcatactccaaggaccaagattagacctgtaagtttgcctgtagatagactacttcttgcaagtcctcctaatgagagaaatggcagaaatatgggaaatgtaaatttagacaagttttgcaagaatcctgcctttgaaggagttaatagaaaagacgctgctactactgtttgttccaaatttaatggctttgaccagcaaactctacagaaaattcaggacaaacagtatgaacaaaacagcctaactgccaagactacaatgatcatgcccagtgcactccaggaaaaaggagtgacaacaagcctccagattagtggggaccattctatcaatgccactcaacccagtaagccatatgcagagccagtcaggtcagtgagagaggcatctgagagacggtcttcagattcctaccctctcgctcctgtcagagcacccagaacactgcagcctcaacattggacaacattttataaaccacatgctcccatcatcagtatcagggggaatgaggagaagccagcttcaccctcagcagcatgccctcctggcacagatcacgatccccacggtctcgtggtgaagtcaatgccagacccagacaaagcatcagcttgtcctgggcaagcaactggtcaacctaaagaagactctgaggagcttggcttgcctgatgtgaatccaatgtgtcagagaccaaggctaaaacgaatgcaacagtttgaagacctcgaagatgaaattccacaatttgtgtagggatgtcaaatttcagggtttttttgttgttgttgtgttattttgtggtattgtgcttgttttgtgaaagaatgttttgacagggccccttttgtataggactgccaaatcatgggttttgccttttgttgttgtatttatcctctgttggtaatactgaatggtagaatgttttgatagggtcacatttgtgcctcactggaattatctttaaattctgtatttttaaagttgtgaataagataggtggattcgtattttttaaagttcagttgactttccccaccaaatggtccatttgaatgcatccctaatatatgatatagtctcaactaataggtgcaatttgggaaaatcaggtttattttttggagtggaactgttataagtgcttatttataaaaggaatgtttctgaatgcaagtgcctaaaaagatctttgttggtatgcatatgttttgtcacacaatttatagtgcatctttcaccatttgtgcttttttaagatagtatgtaagctcttatttttcaattggcaattcagttaatttttaaatgtttacataatggccagaaggcttgcaaatctgtatttaattgcattttaattaattgccagtttttacatgtagtagtcagttgtacaaagaaaatgcacttaaacctgtttctaaattatatattcagttatattatatttggctttagatggttttaatacatttgatagtttttcaccccttggctttattttatataaacttttgtttttcagcagttctgaactttttagtattttataaatggtccaaaaaatgcctgtttcagaagtttttgaattcagtgcatttcctcttgatttgtctgggttaaaaccattccttttgtatgaaatgttttgacttaggaatcattttatgtacttgttctacctggattgtcaacaactgaaagtacatatttcatccaaatcaagctaaaatttatttaagttgattctgagagtacaggtcagtaagcctcattatttggaatttgagagaagtataggtgatcggatctgtttcatttataaaaggtccagtttttaggactagtacattcctgttattttctgggttttatcattttgcctaaaataggatataaaagggacaaaaaataagtagactgtttttatgtgtgaattatatttctactaaatgtttttgtatgactgtgttatacttgataatatatatatatatatataaaaaaaaaaaaaaaaaa

SEQ ID NO: 60 - DNA, 793 bp, Homo sapiens
atgcaggccatcaagtgtgtggtggtgggagatggggccgtgggcaagacctgccttctcatcagctacaccaccaacgcctttcccggagagtacatccccaccgtgtttgacaactattcagccaatgtgatggtggacagcaagccagtgaacctggggctgtgggacactgctgggcaggaggactacgaccgtctccggccgctctcctatccacagacggacgtcttcctcatctgcttctccctcgtcagcccagcctcttatgagaacgtccgcgccaagtggttcccagaagtgcggcaccactgccccagcacacccatcatcctggtgggcaccaagctggacctgcgggacgacaaggacaccatcgagaaactgaaggagaagaagctggctcccatcacctacccgcagggcctggcactggccaaggagattgactcggtgaaatacctggagtgctcagccctcacccagagaggcctgaaaaccgtgttcgacgaggccatccgggccgtgctgtgccctcagcccacgcggcagcagaagcgcgcctgcagcctcctctaggggttgcaccccagcgctcccacctagatgggtctgatccgccgccgccccaggcccgcgggctgctgacagagatacgcgccgtggtgcgcacggagcccttcacgggacgctacagcctgtgccgggccgggagctgggcagggggaaattagcagtggtgagaaaatgtataaagatagattctgggaaagaatttgctgcaaagttcatg

SEQ ID NO: 61 - DNA, 1215 bp, Homo sapiens
atggacagcaggacaaagagcaaggattactgcaaagtaatatttccatatgaggcacagaatgatgatgaattgacaatcaaagaaggagatatagtcactctcatcaataaggactgcatcgacgtaggctggtgggaaggagagctgaacggcagacgaggcgtgttccccgataacttcgtgaagttacttccaccggactttgaaaaggaagggaatagacccaagaagccaccgcctccatccgctcctgtcatcaaacaaggggcaggcaccactgagagaaaacatgaaattaaaaagatacctcctgaaagaccagaaatgcttccaaacagaacagaagaaaaagaaagaccagagagagagccaaaactggatttacagaagccctccgttcctgccataccgccaaaaaagcctcggccacctaagaccaattctctcagcagacctggcgcactgcccccgagaaggccggagagaccggtgggtccgctgacacacaccaggggtgacagtccaaagattgacttggccggcagttcgctatctggcatcctggacaaagatctctcggaccgcagcaatgacattgacttagaaggttttgactccgtggtatcatctactgagaaactcagtcatccgaccacaagcagaccaaaagctacagggaggcggcctccgtcccagtccctcacatcttcatccctttcaagccctgatatcttcgactccccaagtcccgaagaggataaggaggaacacatttcacttgcgcacagaggagtggacgcgtcaaagaaaacttccaagactgttaccatatcccaagtgtctgacaacaaagcatccctgccgcccaagccggggaccatggcagcaggtggcggtgggccagcccctctgtcctcagcggcgccctcccccctgtcatcctctttgggaacagctggacacagagccaactccccgtctctgttcggcacggaaggaaaaccaaagatggagcctgcggccagcagccaggcggccgtggaggagctaaggacacaggtccgcgagctgaggagcatcatcgagaccatgaaggaccagcagaaacgagagattaaacagttattgtctgagttggatgaagagaagaaaatccggcttcggttgcagatggaagtgaacgacataaagaaagctctacaatcaaaatga

SEQ ID NO: 62 - DNA, 642 bp, Homo sapiens
  misc_feature (227)..(227): n is a, c, g, or t
  misc_feature (565)..(565): n is a, c, g, or t
  misc_feature (583)..(583): n is a, c, g, or t
  misc_feature (590)..(590): n is a, c, g, or t
  misc_feature (593)..(593): n is a, c, g, or t
  misc_feature (604)..(604): n is a, c, g, or t
  misc_feature (611)..(611): n is a, c, g, or t
ttttaaatcaaaactgtttattgtaaaaaaaacttgaaaattgttttttaaaaaagaaacattgatttcacaagtcttcaggttgtttatagacatagctatagacaacatctcagtttcatacagaactcattcaatcatataaaaataaacacaaatttacattgactcatcaactatacaatttaaaaaggcacttggaaggggtattgtattattgcatttgnggtatgcatttgaaatagtttaagtacattaatgaatttgtaagaatcctcttttgcacttattcccatctttaattaattttcaaaaattattaaaatgttttaaaatagtaagacaatggagcatgcgccaggaatgttcaaagctaatctttccctcctcccccaaggcacatactgttaattggcaaaaacaaaacacaacaaaaatacttttaatacattctcctgtgttttgttcttgttattttttttctcccttttaaaatatactttaaagcactacaggtaatcaaaaaaaggctttagttcaacaatgggcaccagaccaccgacantgtatggagtaaacttgnaatactnttntaagcacctgnagtcgcngtctgcagatctcttcctatggggaatccta

SEQ ID NO: 63 - DNA, 1977 bp, Homo sapiens
ggcagacaggaagacttctgaagaacaaatcagcctggtcaccagcttttcggaacagcagagacacagagggcagtcatgagtgaggtcaccaagaattccctggagaaaatccttccacagctgaaatgccatttcacctggaacttattcaaggaagacagtgtctcaagggatctagaagatagagtgtgtaaccagattgaatttttaaacactgagttcaaagctacaatgtacaacttgttggcctacataaaacacctagatggtaacaacgaggcagccctggaatgcttacggcaagctgaagagttaatccagcaagaacatgctgaccaagcagaaatcagaagtctagtcacttggggaaactacgcctgggtctactatcacttgggcagactctcagatgctcagatttatgtagataaggtgaaacaaacctgcaagaaattttcaaatccatacagtattgagtattctgaacttgactgtgaggaagggtggacacaactgaagtgtggaagaaatgaaagggcgaaggtgtgttttgagaaggctctggaagaaaagcccaacaacccagaattctcctctggactggcaattgcgatgtaccatctggataatcacccagagaaacagttctctactgatgttttgaagcaggccattgagctgagtcctgataaccaatacgtcaaggttctcttgggcctgaaactgcagaagatgaataaagaagctgaaggagagcagtttgttgaagaagccttggaaaagtctccttgccaaacagatgtcctccgcagtgcagccaaattttacagaagaaaaggtgacctagacaaagctattgaactgtttcaacgggtgttggaatccacaccaaacaatggctacctctatcaccagattgggtgctgctacaaggcaaaagtaagacaaatgcagaatacaggagaatctgaagctagtggaaataaagagatgattgaagcactaaagcaatatgctatggactattcgaataaagctcttgagaagggactgaatcctctgaatgcatactccgatctcgctgagttcctggagacggaatgttatcagacaccattcaataaggaagtccctgatgctgaaaagcaacaatcccatcagcgctactgcaaccttcagaaatataatgggaagtctgaagacactgctgtgcaacatggtttagagggtttgtccataagcaaaaaatcaactgacaaggaagagatcaaagaccaaccacagaatgtatccgaaaatctgcttccacaaaatgcaccaaattattggtatcttcaaggattaattcataagcagaatggagatctgctgcaagcagccaaatgttatgagaaggaactgggccgcctgctaagggatgccccttcaggcataggcagtattttcctgtcagcatctgagcttgaggatggtagtgaggaaatgggccagggcgcagtcagctccagtcccagagagctcctctctaactcagagcaactgaactgagacagaggaggaaaacagagcatcagaagcctgcagtggtggttgtgacgggtaggaggataggaagacagggggccccaacctgggattgctgagcagggaagctttgcatgttgctctaaggtacatttttaaagagttgttttttggccgggcgcagtggctcatgcctgtaatcccagcactttgggaggccgaggtgggcggatcacgaggtctggagtttgagaccatcctggctaacacagtgaaatcccgtctctactaaaaatacaaaaaattagccaggcgtggtggctggcacctgtagtcccagctacttgggaggctgaggcaggagaatggcgtgaacctggaaggaagaggttgcagtgagccaagattgcgccccctgcactccagcctgggcttcagagcaagactcgg

SEQ ID NO: 64 - DNA, 5759 bp, Homo sapiens
ataccctgtggtgctagtgtaaaatcaaatataatctacctctttagcttttctgttatgtaattggaatgaaaaaatagtgcttttttttttttttcatttttgagattgagttaccatggagggaaagaacatgtgttttaccagtggaacgcattctttgtgttatctcttcgatttttaacattttatgtttccagtttataaactttgcctccagtttgatgaagaaaatttagctattagaaagtatttaaaatctcaaaagtatgacattttaaaatgttagcaggtttaaagataacttagtttttcaactcttaacccaaaattatacttgtatactataatttgtgttgaattacttggtattatttatcatcctagtaagatctattttatataatttgattcactttttatattgaattatgttaattgtttttgtaatacacctttcatatttcttcaaagaaaactagtgttgggttattgctaattttgcttcgtggtttggttatttacatataaaaattatattgttttaaaaattgcaaagtgatcatttattgacacatcagcaagaattaatgttgaaatgcaagttttttcccctatccttaactaagtgtgtagatatctttgttttgtttctttaatagatagcaaacaataaagatgcattgaggaagacatggaaccctaagtttacattgagaagtcactttgatggcatccgagcccttgctttccatcccattgagcctgttttgataacagcatcagaggatcacacattaaaaatgtggaatttacagaaaacagccccagccaaaaagtgagaatattctactttaacattatttgaatattttaagtaacattttcagcagaaaactacatattttatgatttctgttaaatttcccaaacatttcttctagttctttcttccatgtcatgtaatttattgtgtttttccatttatacaacctaatgctaggttagaaaactgatgcttaggaagatatggtattatcttttggtttcaccagggtttgtgaatactgattacagtctttatacataacagtatttttaaatggctgctatatttggggagccccttgtctatactgaaggtttggactgttcttgtaaacaggtatatgcatctttaaaataatcaaatgtccacctccaccttgccccattgtttactagatttagacttatgagatggagcagagaaaagcctcactgggatgggtggagggtcttggtcttgtcttttggccttgagactttaggtactttccatacccaccaatatgtctagactcagaggctaacatgactgctagtgctcaccttggccctttagttcctgtctaagcatggatagacatgagttagtataaaccctttaaaagtcacaaagctaaatctggttctacttgcttgggtccttatcggagctccactcctttgggtcacatgtcaaaaaaaaaaaaaaaaaggcgccgtccgctgcgctgggggctcggtctatgacgagcagcggggtctgccatgggtcgggggctgctcaggggcctgtggccgctgcacatcgtcctgtggacgcgtatcgccagcacgatcccaccgcacgttcagaagtcggttaataacgacatgatagtcactgacaacaacggtgcagtcaagtttccacaactgtgtaaattttgtgatgtgagattttccacctgtgacaaccagaaatcctgcatgagcaactgcagcatcacctccatctgtgagaagccacaggaagtctgtgtggctgtatggagaaagaatgacgagaacataacactagagacagtttgccatgaccccaagctcccctaccatgactttattctggaagatgctgcttctccaaagtgcattatgaaggaaaaaaaaaagcctggtgagactttcttcatgtgttcctgtagctctgatgagtgcaatgacaacatcatcttctcagaagaatataacaccagcaatcctgacttgttgctagtcatatttcaagtgacaggcatcagcctcctgccaccactgggagttgccatatctgtcatcatcatcttctactgctaccgcgttaaccggcagcagaagctgagttcaacctgggaaaccggcaagacgcggaagctcatggagttcagcgagcactgtgccatcatcctggaagatgaccgctctgacatcagctccacgtgtgccaacaacatcaaccacaacacagagctgctgcccattgagctggacaccctggtggggaaaggtcgctttgctgaggtctataaggccaagctgaagcagaacacttcagagcagtttgagacagtggcagtcaagatctttccctatgaggagtatgcctcttggaagacagagaaggacatcttctcagacatcaatctgaagcatgagaacatactccagttcctgacggctgaggagcggaagacggagttggggaaacaatactggctgatcaccgccttccacgccaagggcaacctacaggagtacctgacgcggcatgtcatcagctgggaggacctgcgcaagctgggcagctccctcgcccgggggattgctcacctccacagtgatcacactccatgtgggaggcccaagatgcccatcgtgcacagggacctcaacagctccaatatcctcgtgaagaacgacctaacctgctgcctgtgtgactttgggctttccctgcgtctggaccctactctgtctgtggatgacctggctaacagtgggcaggtgggaactgcaagatacatggctccagaagtcctagaatccaggatgaatttggagaatgctgagtccttcaagcagaccgatgtctactccatggctctggtgctctgggaaatgacatctcgctgtaatgcagtgggagaagtaaaagattatgagcctccatttggttccaaggtgcgggagcacccctgtgtcgaaagcatgaaggacaacgtgttgagagatcgagggcgaccagaaattcccagcttctggctcaaccaccagggcatccagatggtgtgtgagacgttgactgagtgctgggaccacgacccagaggcccgtctcacagcccagtgtgtggcagaacgcttcagtgagctggagcatctggacaggctctcggggaggagctgctcggaggagaagattcctgaagacggctccctaaacactaccaaatagctcttctggggcaggctgggccatgtccaaagaggctgcccctctcaccaaagaacagaggcagcaggaagctgcccctgaactgatgcttcctggaaaaccaagggggtcactcccctccctgtaagctgtggggataagcagaaacaacagcagcagggagtgggtgacatagagcattctatgccttttacattgtcataggataagctgtgttagcacttcctcaggaaatgagattgattttacaatagccaataacatttgcactttattaatgcctgtatataaatatgaatagctatgttttatatatatatatatatatctatatatgtctatagctctatatatatagccataccttgaaaagagacaaggaaaaacatcaaatattcccaggaaattggttttattggagaactccagaaccaagcagagaaggaagggacccatgacagcattagcatttgacaatcacacatgcagtggttctctgactgtaaaacagtgaactttgcatgaggaaagaggctccatgtctcacagccagctatgaccacattgcacttgcttttgcaaaataatcattccctgcctagcacttctcttctggccatggaactaagtacagtggcactgtttgaggaccagtgttcccggggttcctgtgtgcccttatttctcctggacttttcatttaagctccaagccccaaatctggggggctagtttagaaactctccctcaacctagtttagaaactctaccccatctttaataccttgaatgttttgaaccccactttttaccttcatgggttgcagaaaaatcagaacagatgtccccatccatgcgattgccccaccatctactaatgaaaaattgttctttttttcatctttcccctgcacttatgttactattctctgctcccagccttcatccttttctaaaaaggagcaaattctcactctaggctttatcgtgtttactttttcattacacttgacttgattttctagttttctatacaaacaccaatgggttccatctttctgggctcctgattgctcaagcacagtttggcctgatgaagaggatttcaactacacaatactatcattgtcaggactatgacctcaggcactctaaacatatgttttgtttggtcagcacagcgtttcaaaaagtgaagccactttataaatatttggagattttgcaggaaaatctggatccccaggtaaggatagcagatggttttcagttatctccagtccacgttcacaaaatgtgaaggtgtggagacacttacaaagctgcctcacttctcactgtaaacattagctctttccactgcctacctggaccccagtctaggaattaaatctgcacctaaccaaggtcccttgtaagaaatgtccattcaagcagtcattctctgggtatataatatgattttgactaccttatctggtgttaagatttgaagttggccttttattggactaaaggggaactcctttaagggtctcagttagcccaagtttcttttgcttatatgttaatagttttaccctctgcattggagagaggagtgctttactccaagaagctttcctcatggttaccgttctctccatcatgccagccttctcaacctttgcagaaattactagagaggatttgaatgtgggacacaaaggtcccatttgcagttagaaaatttgtgtccacaaggacaagaacaaagtatgagctttaaaactccataggaaacttgttaatcaacaaagaagtgttaatgctgcaagtaatctcttttttaaaactttttgaagctacttattttcagccaaataggaatattagagagggactggtagtgagaatatcagctctgtttggatggtggaaggtctcattttattgagatttttaagatacatgcaaaggtttggaaatagaacctctaggcaccctcctcagtgtgggtgggctgagagttaaagacagtgtggctgcagtagcatagaggcgcctagaaattccacttgcaccgtagggcatgctgataccatcccaatagctgttgcccattgacctctagtggtgagtttctagaatactggtccattcatgagatattcaagattcaagagtattctcacttctgggttatcagcataaactggaatgtagtgtcagaggatactgtggcttgttttgtttatgtttttttttcttattcaagaaaaaagaccaaggaataacattctgtagttcctaaaaatactgacttttttcactactatacataaagggaaagttttattcttttatggaacacttcagctgtactcatgtattaaaataggaatgtgaatgctatatactctttttatatcaaaagtctcaagcacttatttttattctatgcattgtttgtcttttacataaataaaatgtttattagattg

SEQ ID NO: 65 - DNA, 2303 bp, Homo sapiens
cccggcgtcccgtcgagcccagccccgccgggggcgctcctcgccgcccgcacgccctccccagccatgtcgtccatcctgcctttcactcccccgatcgtgaagcgcctgctgggctggaagaagggcgagcagaacgggcaggaggagaaatggtgcgagaaggcggtcaagagcctggtcaagaaactcaagaagacggggcagctggacgagctggagaaggccatcaccacgcagaacgtcaacaccaagtgcatcaccatccccaggtccctggatggccggttgcaggtgtcccatcggaaggggctccctcatgtcatctactgccgcctgtggcgatggccagacctgcacagccaccacgagctgcgggccatggagctgtgtgagttcgccttcaatatgaagaaggacgaggtctgcgtgaatccctaccactaccagagagtagagacaccagttctacctcctgtgttggtgccacgccacacagagatcccggccgagttccccccactggacgactacagccattccatccccgaaaacactaacttccccgcaggcatcgagccccagagcaatattccagagaccccaccccctggctacctgagtgaagatggagaaaccagtgaccaccagatgaaccacagcatggacgcaggttctccaaacctatccccgaatccgatgtccccagcacataataacttggacctgcagccagttacctactgcgagccggccttctggtgctccatctcctactacgagctgaaccagcgcgtcggggagacattccacgcctcgcagccatccatgactgtggatggcttcaccgacccctccaattcggagcgcttctgcctagggctgctctccaatgtcaacaggaatgcagcagtggagctgacacggagacacatcggaagaggcgtgcggctctactacatcggaggggaggtcttcgcagagtgcctcagtgacagcgctatttttgtccagtctcccaactgtaaccagcgctatggctggcacccggccaccgtctgcaagatcccaccaggatgcaacctgaagatcttcaacaaccaggagttcgctgccctcctggcccagtcggtcaaccagggctttgaggctgtctaccagttgacccgaatgtgcaccatccgcatgagcttcgtcaaaggctggggagcggagtacaggagacagactgtgaccagtaccccctgctggattgagctgcacctgaatgggcctttgcagtggcttgacaaggtcctcacccagatgggctccccaagcatccgctgttccagtgtgtcttagagacatcaagtatggtaggggagggcaggcttggggaaaatggccatacaggaggtggagaaaattggaactctactcaacccattgttgtcaaggaagaagaaatctttctccctcaactgaaggggtgcacccacctgttttctgaaacacacgagcaaacccagaggtggatgttatgaacagctgtgtctgccaaacacatttaccctttggccccactttgaagggcaagaaatggcgtctgctctggtggcttaagtgagcagaacaggtagtattacaccaccggcaccctccccccagactctttttttgagtgacagctttctgggatgtcacagtccaaccagaaacgcccctctgtctaggactgcagtgtggagttcaccttggaagggcgttctaggtaggaagagcccgcacgatgcagacctcatgcccagctctctgacgcttgtgacagtgcctcttccagtgaacattcccagcccagccccgccccgttgtgagctggatagacttgggatggggagggagggagttttgtctgtctccctcccctctcagaacatactgattgggaggtgcgtgttcagcagaacctgcacacaggacagcgggaaaaatcgatgagcgccacctctttaaaaactcacttacgttgtcctttttcactttgaaaagttggaaggactgctgaggcccagtgcatatgcaatgtatagtgtctattatcacattaatctcaaagagattcgaatgacggtaagtgttctcatgaagcaggaggcccttgtcgtgggatggcatttggtctcaggcagcaccacactgggtgcgtctccagtcatctgtaagagcttgctccagattctgatgcatacggctatattggtttatgtagtcagttgcattcattaaatcaactttatcatatgctcaaaaaaaaaaaaaag

SEQ ID NO: 66 - DNA, 3250 bp, Homo sapiens
cggacgcgtgggccggttcagccatggggacctctccgagcagcagcaccgccctcgcctcctgcagccgcatcgcccgccgagccacagccacgatgatcgcgggctcccttctcctgcttggattccttagcaccaccacagctcagccagaacagaaggcctcgaatctcattggcacataccgccatgttgaccgtgccaccggccaggtgctaacctgtgacaagtgtccagcaggaacctatgtctctgagcattgtaccaacacaagcctgcgcgtctgcagcagttgccctgtggggacctttaccaggcatgagaatggcatagagaaatgccatgactgtagtcagccatgcccatggccaatgattgagaaattaccttgtgctgccttgactgaccgagaatgcacttgcccacctggcatgttccagtctaacgctacctgtgccccccatacggtgtgtcctgtgggttggggtgtgcggaagaaagggacagagactgaggatgtgcggtgtaagcagtgtgctcggggtaccttctcagatgtgccttctagtgtgatgaaatgcaaagcatacacagactgtctgagtcagaacctggtggtgatcaagccggggaccaaggagacagacaacgtctgtggcacactcccgtccttctccagctccacctcaccttcccctggcacagccatctttccacgccctgagcacatggaaacccatgaagtcccttcctccacttatgttcccaaaggcatgaactcaacagaatccaactcttctgcctctgttagaccaaaggtactgagtagcatccaggaagggacagtccctgacaacacaagctcagcaagggggaaggaagacgtgaacaagaccctcccaaaccttcaggtagtcaaccaccagcaaggcccccaccacagacacatcctgaagctgctgccgtccatggaggccactgggggcgagaagtccagcacgcccatcaagggccccaagaggggacatcctagacagaacctacacaagcattttgacatcaatgagcatttgccctggatgattgtgcttttcctgctgctggtgcttgtggtgattgtggtgtgcagtatccggaaaagctcgaggactctgaaaaaggggccccggcaggatcccagtgccattgtggaaaaggcagggctgaagaaatccatgactccaacccagaaccgggagaaatggatctactactgcaatggccatggtatcgatatcctgaagcttgtagcagcccaagtgggaagccagtggaaagatatctatcagtttctttgcaatgccagtgagagggaggttgctgctttctccaatgggtacacagccgaccacgagcgggcctacgcagctctgcagcactggaccatccggggccccgaggccagcctcgcccagctaattagcgccctgcgccagcaccggagaaacgatgttgtggagaagattcgtgggctgatggaagacaccacccagctggaaactgacaaactagctctcccgatgagccccagcccgcttagcccgagccccatccccagccccaacgcgaaacttgagaattccgctctcctgacggtggagccttccccacaggacaagaacaagggcttcttcgtggatgagtcggagccccttctccgctgtgactctacatccagcggctcctccgcgctgagcaggaacggttcctttattaccaaagaaaagaaggacacagtgttgcggcaggtacgcctggacccctgtgacttgcagcctatctttgatgacatgctccactttctaaatcctgaggagctgcgggtgattgaagagattccccaggctgaggacaaactagaccggctattcgaaattattggagtcaagagccaggaagccagccagaccctcctggactctgtttatagccatcttcctgacctgctgtagaacatagggatactgcattctggaaattactcaatttagtggcagggtggttttttaattttcttctgtttctgatttttgttgtttggggtgtgtgtgtgtgtttgtgtgtgtgtgtgtgtgtgtgtgtgtgtgtgtttaacagagaatatggccagtgcttgagttctttctccttctctctctctcttttttttttaaataactcttctgggaagttggtttataagcctttgccaggtgtaactgttgtgaaatacccaccactaaagttttttaagttccatattttctccattttgccttcttatgtattttcaagattattctgtgcactttaaatttacttaacttaccataaatgcagtgtgacttttcccacacactggattgtgaggctcttaacttcttaaaagtataatggcatcttgtgaatcctataagcagtctttatgtctcttaacattcacacctactttttaaaaacaaatattattactatttttattattgtttgtcctttataaattttcttaaagattaagaaaatttaagaccccattgagttactgtaatgcaattcaactttgagttatcttttaaatatgtcttgtatagttcatattcatggctgaaacttgaccacactattgctgattgtatggttttcacctggacaccgtgtagaatgcttgattacttgtactcttcttatgctaatatgctctgggctggagaaatgaaatcctcaagccatcaggatttgctatttaagtggcttgacaactgggccaccaaagaacttgaacttcaccttttaggatttgagctgttctggaacacattgctgcactttggaaagtcaaaatcaagtgccagtggcgccctttccatagagaatttgcccagctttgctttaaaagatgtcttgttttttatatacacataatcaataggtccaatctgctctcaaggccttggtcctggtgggattccttcaccaattactttaattaaaaatggctgcaactgtaagaacccttgtctgatatatttgcaactatgctcccatttacaaatgtaccttctaatgctcagttgccaggttccaatgcaaaggtggcgtggactccctttgtgtgggtggggtttgtgggtagtggtgaaggaccgatatcagaaaaatgccttcaagtgtactaatttattaataaacattaggtgtttgttaaaaaaaaaaaaaaaaaaaaaaaaaaaaa

SEQ ID NO: 67 - DNA, 1216 bp, Homo sapiens
gtagcggcgcgcgagcgggccgggcgggcggccgagttttccaagagataacttcaccaagatgtccagtgataggcaaaggtccgatgatgagagccccagcaccagcagtggcagttcagatgcggaccagcgagacccagccgctccagagcctgaagaacaagaggaaagaaaaccttctgccacccagcagaagaaaaacaccaaactctctagcaaaaccactgctaagttatccactagtgctaaaagaattcagaaggagctagctgaaataacccttgatcctcctcctaattgcagtgctgggcctaaaggagataacatttatgaatggagatcaactatacttggtccaccgggttctgtatatgaaggtggtgtgttttttctggatatcacattttcatcagattatccatttaagccaccaaaggttactttccgcaccagaatctatcactgcaacatcaacagtcagggagtcatctgtctggacatccttaaagacaactggagtcccgctttgactatttcaaaggttttgctgtctatttgttcccttttgacagactgcaaccctgcggatcctctggttggaagcatagccactcagtatttgaccaacagagcagaacacgacaggatagccagacagtggaccaagagatacgcaacataattcacataatttgtatgcagtgtgaaggagcagaaggcatcttctcactgtgctgcaaatctttatagcctttacaatacggacttctgtgtatatgttatactgattctactctgcttttatcctttggagcctgggagactccccaaaaaggtaaatgctatcaagagtagaactttgtagctgtagattagttatgtttaaaacgcctacttgcaagtcttgcttctttgggatatcaaaatgtattttgtgatgtactaaggatactggtcctgaagtctaccaaatattatagtgcattttagcctaattcattatctgtatgaagttataaaagtagctgtagatggctaggaattatgtcatttgtattaaacccagatctatttctgagtatgtggttcatgctgttgtgaaaaatgttttaccttttacctttgtcagtttgtaatgagaggatttccttttaccctttgtagctcagagagcacctgatgtatcatctcaaacacaataaacatgctcctg

SEQ ID NO: 68 - DNA, 2201 bp, Homo sapiens
ggcacgaggccctccccgcccggctggaggctgctccggaccgggacgcagagtctgcggacccggcgccgaggcggccacccgagacgcggcgcgcacgctccggcctgcgcccggcccggccatggcggccccccgcccgtctcccgcgatctccgtttcggtctcggctccggctttttacgccccgcagaagaagttcggccctgtggtggccccaaagcccaaagtgaatcccttccggaagactttcccctgcctccacctccccttgctggggatggcgacgatgcagagggtgctctgggaggtgccttcccgccgccccctcccccgatcgaggaatcatttccccctgcgcctctggaggaggagatcttcccttccccgccgcctcctccggaggaggagggagggcctgaggcccccataccgcccccaccacagcccagggagaaggtgagcagtattgatttggagatctctctgtcctcactgctggatgacatgaccaagaatgatcctttcaaagcccgggtgtcatctggatatgtgcccccaccagtggccactccattcagttccaagtccagtaccaagcctgcagccgggggcacagcacccctgcctccttggaagtccccttccagctcccagcctctgccccaggttccggctccggctcagagccagacacagttccatgttcagccccagccccagcccaagcctcaggtccaactccatgtccagtcccagacccagcctgtgtctttggctaacacccagccccgagggcccccagcctcatctccggctccagcccctaagttttctccagtgactcctaagtttactcctgtggcttccaagttcagtcctggagccccaggtggatctgggtcacaaccaaatcaaaaattggggcaccccgaagctctttctgctggcacaggctcccctcaacctcccagcttcacctatgcccagcagagggagaagccccgagtgcaggagaagcagcaccccgtgcccccaccggctcagaaccaaaaccaggtgcgctcccctggggccccagggcccctgactctgaaggaggtggaggagctggagcagctgacccagcagctaatgcaggacatggagcatcctcagaggcagaatgtggctgtcaacgaactctgcggccgatgccatcaacccctggcccgggcgcagccagccgtccgcgctctagggcagctgttccacatcgcctgcttcacctgccaccagtgtgcgcagcagctccagggccagcagttctacagtctggagggggcgccgtactgcgagggctgttacactgacaccctggagaagtgtaacacctgcggggagcccatcactgaccgcatgctgagggccacgggcaaggcctatcacccgcactgcttcacctgtgtggtctgcgcccgccccctggagggcacctccttcatcgtggaccaggccaaccggccccactgtgtccccgactaccacaagcagtacgccccgaggtgctccgtctgctctgagcccatcatgcctgagcctggccgagatgagactgtgcgagtggtcgccctggacaagaacttccacatgaagtgttacaagtgtgaggactgcgggaagcccctgtcgattgaggcagatgacaatggctgcttccccctggacggtcacgtgctctgtcggaagtgccacactgctagagcccagacctgagtgaggacaggccctcttcagaccgcagtccatgccccattgtggaccacccacactgagaccacctgcccccacctcagttattgttttgatgtctagcccctcccatttccaacccctccctagcatcccaggtgccctgacccaggacccaacatggtctagggatgcaggatccccgccctggggtctggtcctcgcccatcctgcagggattgcccaccgtcttccagacaccccacctgaggggggcaccaggtttagtgctgctgctttcactgctgcacccgcgccctcggctggccccccgagcagcctttgtactctgcttgcggagggctgggagaccctccaggacattcccaccctcccccatgctgccaagttgtagctatagctacaaataaaaaaaaaccttgttttccagaaaaaaaaaaaaaaaaaaa

SEQ ID NO: 69 - DNA, 1219 bp, Homo sapiens
gagaacatccatctacagtcctcctttgcttggtggattgggctcagaggaacaaaaagttagtctgactctgtgcatattagcatcatgtctttagagaaaggtcagcctctctggttgccaaatactcatcatgatgctcatgacttaaaggttctgaggagccttgtctcccttggatttttgagtcagggtacaggaaaaaacattgctgactaactaactgcaaatgcatctgcaggtgaaaccctacgaaagcacagttctggctataaacttcagagttctctgtaaaaaacttagagcactagaagcacaggaatagtgagtgtacagcttatgcggttgtagaggggcaactgatgaacacaggtcccacatatatgagggagtatgacgttctctacctaatatgttctgtgtgcatgttttgaatgattgaagatgggattaactaatgcaagtttacagttgcctcctaaaacacacattctgtataattatcgctaaatacaatgctgtgaggtctatagttcctgtaacccctttctcctccccaaggacagagaagaactagccatgtgctatagggaaccctgagtgccctactcttttcccaagaagggtaaagcctacaatatcatcagggggcatgaagcacattaatttgcagtggctgcttcatatgaggaggtatggtggacaggctaatttttccttgaaaatgtggcttcttcaactcctttcaaatttaggatggaatacttcctgaaataaaactgggctttatgcaggattctctttgaaaattcttgtatgtccagaacaaaagataaaactaattgtattcctcacattcacaatccccattggtctgaagtcacgtagcacagagcatctatagcacatagtgtttaaagactaatgaatgcaaaaagataaaatcttcaactaatttttgaattgtttctcatatatgctactagaaaatgccttgttgatgaagcacattttgggtagttgaggtcttttgttttcgcctttagctttctaagctttcttacaatgtggactgattactgtaacatttcacgtgtaaaataactggatattctttatatactggaaataacctgtgaatccaatatttcactaagtgttttaacttttgtgtatatatctctcatcaataaatgtggatttcaaaaaaaaaaaaaaa

SEQ ID NO: 70 - DNA, 482 bp, Homo sapiens
gtcctataggcgctaggtggaaatagcaaaaacaaggcccaggctgggcaggccagaggggaaggccctggattctcactcatgtgagatcttgaatctctttctttgttctgtttgtttagttagtatcatctggtaaaatagttaaaaaacaacaaaaaactctgtatctgtttctagcatgtgctgcattgactctattaatcacatttcaaattcaccctacattcctctcctcttcactagcctctctgaaggtgtcctggccagccctggagaagcactggtgtctgcagcacccctcagttcctgtgcctcagcccacaggccactgtgataatggtctgtttagcacttctgtatttattgtaagaatgcttatcatgaagatacacactgtaactacaagaaattataaatgtttttcacatcaaaaaaaaaaaaaaaaaaacaaacaaaacaacacacaaaaccaaaaaaaa

SEQ ID NO: 71 - DNA, 456 bp, Homo sapiens
tttttttttttttttttcagggcagaagagggtgaaataagttggactcttgtttttattctcaaatgctccctggaaacatactttggggaatctgtttttaaagtgagcttatgtcacataggcttgatactgtctagaaaaatctcttcaggtgagggtggggcctcaactaagagtgcaggcccgaagagcctcccaaaggaaacttctagaatcaggctgtgggctgtgactctcctcagcaaagccacgcagaggtaaggtgcttcaattcagggacttacaaaagggcctccctgctctgctcagatggggaaaagttgatgatggtttttttttgttttttaaaaaaacaccttcttgccactttcatttcccttagcattttatttatatccacaatgttgttcttgaaaaacagataggtaaccaaaaaggaaaaacagagctgca

SEQ ID NO: 72 - DNA, 2278 bp, Homo sapiens
ggggagtgctccattttccccgacagcgaatttcccctgagaaacgatactagaccctgggtttgcccaccttgtaactcttccttatctcctccttttcatccctaattcatcctccctctggcatggaattgacgcccgtgcagtacatttgccaagtggcaccttctttcaatttatgttttattttgctatggtggtgattctttatttgctggttgtcttttctcacacatctttctctctgtctctctctttcctgctctttgtttttctgcccagaaaaacctgacttcgataccaaaaaagatgaaactacagaaactcaaatttaaaaaaaactttaaaagaaacaaaaaaatactcaacgattctttcagctttattaacattttccattgtttcttgcgacttgtgtctcgttctttgtagtattgatgatgaacatttgataatgaatgttcttgtatattcagataaagaaaaaaaaaaccaaaaaagcggtctgaatttaatagtgtttataataaaaattttaaaaatgaccctcatagcacgcaaaacaggatggggaatttcccctcttctttctgtgacaatgcgcatcattcctgcattagtttttaacaccagactacctacattcatcatttccctcatttttcttttattttcttgcatttgtgaattagttcaagaatgctagaaaagtgtcgagttgtgcacatccatttcttgtttcacaatgtttaaaagtgacagtaattcattttgtaaactaaaaaaaaaaaaaaaaaggttggaatagtgagcataataggtacaacctaacacattattatgtttattaactttgagacccagaaataaattcttttcttttcttgattcttgctcttaaaaatacaaaaaaaaaaatgttttgttttgtgttatttttggtttgtttattggggggctttttttaattgtcaggattatgatcttgctgtttttcttcaatatgtatacaaggtgatgtgaaaagatgacttgggcagaggagtaagaacaagtaggcttgttcttctactttgcttcagaattcagttaatgccaaaagcgaagatcaagcccatgttgatgtctcgttgctcacctgcatttccagagagtgtgacactcatgcagtccctgagaaaaataaaatcagggacatacttctccttttagccttttaaaaattcaaaaacgtttagtccaagggaactttttatgctatcaggaaaggtttttgctgtttttgattctgattatcacagccaagtactttgttttatttctccctaattaataactacattccatgaggcctcttccaaccaaagaggccttttcttccaggagagtcccgcaggagatgctggtatgatgggcaccattggttaagtaaactacatgcaggaagaagtccttggggccagtctgccagctgagtcctggttttggatgaagagttaatgagatattgggccaggctcaatgctgtagttttaatgctaagaggttacgtttacttcacagagtacacctcttagtaacctctgacttaggcagctgcttaaagcaaattgcaaaactggcttgatttggaatgtttttattagaggaaaaaagaaagccatattatctggaaaaaaattcattttaaataccatcattcaacaaattatgttcagaaagtggtcagaacttaagcaagaaaagtaaagaaagaatgcagaattgtggagcaatgctttaggaaatatttctacctgaacacttgtactcttgaagtcacaacaaaataatgatgagcttttcacatcacctttatggtttcaatccctagctcaaagcttcctggaatcttttattttttgtaaacttttttttcttttgttaaaataaataaaacattcaatgtttttctccttttctctcttattacttctttcctttggcattttcaatttgaaatgctttcctttggttgttggttttattctccccctacccctccccttttcttattattcagaatataaacctgcaaagctctgctctgttttggttttgaaagtttaagcttttctgcttctgtgagagcacaggcttctgtcccttttgattccaactgaacttttgtgttctctaatgatactaacacggtgtaggttttacagtctcctaatttgtactggtaatgcatattccaaataaatagtttcttttgttgcaaaaaaaaaaaaaaaaa

SEQ ID NO: 73 - DNA, 1819 bp, Homo sapiens
cttccctgtttatcctgaaaaggatttgaagacaagcttgaaggataaaaagccttggtgcttcccaggagccgagccgaggagcagaagaggaagagccgggggctgccgtagcctttggagatggacgagcagcccaggctgatgcattcccatgctggggtcgggatggccggacaccccggcctgtcccagcacttgcaggatggggccggagggaccgagggggagggcgggaggaagcaggacattggagacattttacagcaaattatgaccatcacagaccagagtttggatgaggcgcaggccagaaaacatgctttaaactgccacagaatgaagcctgccttgtttaatgtgttgtgtgaaatcaaagaaaaaacagttttgagtatccgaggagcccaggaggaggaacccacagacccccagctgatgcggctggacaacatgctgttagcggaaggcgtggcggggcctgagaagggcggagggtcggcggcagcggcggcagcggcggcggcttctggaggggcaggttcagacaactcagtggagcattcagattacagagccaaactctcacagatcagacaaatctaccatacggagctggagaaatacgagcaggcctgcaacgagttcaccacccacgtgatgaatctcctgcgagagcaaagccggaccaggcccatctccccaaaggagattgagcggatggtcagcatcatccaccgcaagttcagctccatccagatgcagctcaagcagagcacgtgcgaggcggtgatgatcctgcgttcccgatttctggatgcgcggcggaagagacggaatttcaacaagcaagcgacagaaatcctgaatgaatatttctattcccatctcagcaacccttaccccagtgaggaagccaaagaggagttagccaagaagtgtggcatcacagtctcccaggtatcaaactggtttggaaataagcgaatccggtacaagaagaacataggtaaatttcaagaggaagccaatatttatgctgccaaaacagctgtcactgctaccaatgtgtcagcccatggaagccaagctaactcgccctcaactcccaactcggctggttcttccagttcttttaacatgtcaaactctggagatttgttcatgagcgtgcagtcactcaatggggattcttaccaaggggcccaggttggagccaacgtgcaatcacaggtggatacccttcgccatgttatcagccagacaggaggatacagtgatggactcgcagccagtcagatgtacagtccgcagggcatcagtgctaatggaggttggcaggatgctactaccccttcatcagtgacctcccctacagaaggccctggcagtgttcactctgatacctccaactgatctcccagcaatcgcatcccggctgaccctctgccccagttggggcaggggcaggagggagggtttctctcccaagctgaagcggtcagactggaggtcgaagcaatcagcaaacacaataagagtctccttctcttctcttctttgggatgctatttcagccaatctggacacttctttatactctcttcccttttttttctgggtagaagccacccttccctgcctccagctgtcagcctggttttcgtcatcttccctgcccctgtgcctctgtcctagacttcccggggtccccgccctctctcatatcactgaaggatattttcaacaattagaggaatttaaagaggaaaaaaattacaaagaaaataataaaagtgtttgtacgttttcaaaaaaa

SEQ ID NO: 74 - DNA, 495 bp, Homo sapiens
  misc_feature (10)..(10): n is a, c, g, or t
  misc_feature (31)..(31): n is a, c, g, or t
  misc_feature (162)..(162): n is a, c, g, or t
  misc_feature (201)..(201): n is a, c, g, or t
  misc_feature (209)..(209): n is a, c, g, or t
  misc_feature (212)..(212): n is a, c, g, or t
  misc_feature (226)..(226): n is a, c, g, or t
  misc_feature (267)..(267): n is a, c, g, or t
  misc_feature (314)..(314): n is a, c, g, or t
  misc_feature (371)..(371): n is a, c, g, or t
  misc_feature (399)..(399): n is a, c, g, or t
  misc_feature (409)..(409): n is a, c, g, or t
  misc_feature (428)..(428): n is a, c, g, or t
  misc_feature (433)..(433): n is a, c, g, or t
  misc_feature (465)..(465): n is a, c, g, or t
cgtggggttnactgatggtggctgctgtcanattccaagtggcttatgggataggacaaccccccaggcacttcactgtaggacagttagcaccaagagctaaggttgtgagataatgcaaatctggcctgtcacctctgcagagtacaggttcccatactntgaggcagcagcagagagggaaccaccagagaaacagcntttcaganttntctttcctttggtntatggatatgtgtgtgttctagtctttggtgggcaatggantctgcagctccatgacaatcttgttaagtagcttatgtggggaagtntttcagggtcacaagggccacccattctaaggcttctcattttaatttccccagggnttaaggaggacaggtggggggaaagggnaaaaaccttngcacctttgctattacttnaattngggattccaggaggcccaatccaatggcattntttaccctacttttcttgggcccaaatcca

SEQ ID NO: 75 - DNA, 871 bp, Homo sapiens
gccagaacccaagggaacgtcatggaggccacatggggccacccggctccctcgggatggctccgcctgcacttttgaaaccccggtttccttcaacgtccacattccaggtgaccacacgtgtctcctcctcctcatcttagcttccaggttcaccctaaccctgtactaacctgcttggtggacttggaaaagacttggctctgtcgggaaaggagagacggggcctccatcacgcctgttaccagaggatccccgagagccacaccagctctggacatcaccgcccctggaactggggccaccagccctgggcacgagatttgctctgactttatttatatggcatgaaatctctggtttattttgggattttttgtctgtcggtgtcgtcaaagttcgccctctttctaaagtcgtgtgatctatatatctgacattttacatctcacagacaccggtatgtcgtctaacaggggaccaacagacggtagtattgacaactgttcccgcttctactaccaccacaccagagcacaacccgaaacccctacctccactcgccacaccttccccacatgtcctggcgctccctgtccgtcactacttagccggtcgcacccgtgtcgtccccgcgcgtatcgaccgccgcactcccttcccccaccctccattctccagcgcctcgcccgccgccccaacccgcccccctccactgaccggctcccacgccccgagacgcgcccaccagcgccggcacctgacccccaccgcacccccactcgggcccagccccccggcccaagcgcccgggcacccccgccgccgcccccccacaccccccgaccaaccccccgacacggcccctgac

SEQ ID NO: 76 - DNA, 956 bp, Homo sapiens
aagtaaatgcagcactagtgggtgggattgaggctatgccctggtgcataaatagagactcagctgtgctggcacactcagaagcttggaccgcatcctagccgccgactcacacaaggcaggtgggtgaggaaatccagagttgccatggagaaaattccagtgtcagcattcttgctccttgtggccctctcctacactctggccagagataccacagtcaaacctggagccaaaaaggacacaaaggactctcgacccaaactgccccagaccctctccagaggttggggtgaccaactcatctggactcagacatatgaagaagctctatataaatccaagacaagcaacaaacccttgatgattattcatcacttggatgagtgcccacacagtcaagctttaaagaaagtgtttgctgaaaataaagaaatccagaaattggcagagcagtttgtcctcctcaatctggtttatgaaacaactgacaaacacctttctcctgatggccagtatgtccccaggattatgtttgttgacccatctctgacagttagagccgatatcactggaagatattcaaatcgtctctatgcttacgaacctgcagatacagctctgttgcttgacaacatgaagaaagctctcaagttgctgaagactgaattgtaaagaaaaaaaatctccaagcccttctgtctgtcaggccttgagacttgaaaccagaagaagtgtgagaagactggctagtgtggaagcatagtgaacacactgattaggttatggtttaatgttacaacaactattttttaagaaaaacaagttttagaaatttggtttcaagtgtacatgtgtgaaaacaatattgtatactaccatagtgagccatgattttctaaaaaaaaaaataaatgttttgggggtgttctgttttctccaaaaaaaaaaaaaaa

SEQ ID NO: 77 - DNA, 591 bp, Homo sapiens
atggcggccatccgcaagaagctggtggtggtgggcgacggcgcgtgtggcaagacgtgcctgctgatcgtgttcagtaaggacgagttccccgaggtgtacgtgcccaccgtcttcgagaactatgtggccgacattgaggtggacggcaagcaggtggagctggcgctgtgggacacggcgggccaggaggactacgaccgcctgcggccgctctcctacccggacaccgacgtcattctcatgtgcttctcggtggacagcccggactcgctggagaacatccccgagaagtgggtccccgaggtgaagcacttctgtcccaatgtgcccatcatcctggtggccaacaaaaaagacctgcgcagcgacgagcatgtccgcacagagctggcccgcatgaagcaggaacccgtgcgcacggatgacggccgcgccatggccgtgcgcatccaagcctacgactacctcgagtgctctgccaagaccaaggaaggcgtgcgcgaggtcttcgagacggccacgcgcgccgcgctgcagaagcgctacggctcccagaacggctgcatcaactgctgcaaggtgctatga

SEQ ID NO: 78 - DNA, 1414 bp, Homo sapiens
cgattgaggaacccatttcctcattctgcaaattgcaaacctgagggcccaaagagggacaggggcttgccaggtctcagcaggctgtgagcaagagctaaagcctaatcctcctgcctttgggctggagccttccttgtaccccagggtcagtgtctttgttggatacaggcttagattgactgactgtaccctgagaacctaggggagtccctgttcccaattcttctcctacccccaccttggcctgatggaggaagaccctgctgtgttgagatgagcaccagagccaagaagctgaggaggatctggagaattctggaggaagaggagagtgttgctggagctgtacagaccctgcttctcaggtcccaggaaggtggcgtcacatctgcagccgcgtcgacgttgtcggagcctccgcggaggacccaggagagccggactaggaccagggccctgggcctccccacactccccatggagaagctggcggcctctacagagccccaagggcctcggccggtcctgggccgtgagagtgtccaggtgcccgatgaccaagactttcgcagcttccggtcagagtgtgaggctgaggtgggctggaacctgacctatagcagggctggggtgtctgtctgggtgcaggctgtggagatggatcggacgctgcacaagatcaagtgccggatggagtgctgtgatgtgccagccgagacactctacgacgtcctacacgacattgagtaccgcaagaaatgggacagcaacgtcattgagacttttgacatcgcccgcttgacagtcaacgctgacgtgggctattactcctggaggtgtcccaagcccctgaagaaccgtgatgtcatcaccctccgctcctggctccccatgggcgctgattacatcattatgaactactcagtcaaacatcccaaatacccacctcggaaagacttggtccgagctgtgtccatccagacgggctacctcatccagagcacagggcccaagagctgcgtcatcacctacctggcccaggtggaccccaaaggctccttacccaagtgggtggtgaataaatcttctcagttcctggctcccaaggccatgaagaagatgtacaaggcgtgcctcaagtaccccgagtggaaacagaagcacctgcctcacttcaagccgtggctgcacccggagcagagcccgttgccgagcctggcgctgtcggagctgtcggtgcagcatgcggactcactggagaacatcgacgagagcgcggtggccgagagcagagaggagcggatgggcggcgcgggcggcgagggcagcgacgacgacacctcgctcacctgagcgacgcaccgcttcagggacggagacaggaccggcggagccctggggcggcggccgc

SEQ ID NO: 79 - DNA, 2000 bp, Homo sapiens
cttggcacgagggattggtctgtgctcctctctcggctcctcgcggctcgcggcggccgacggttcctgggacacctgcttgcttggcccgtccggcggctcagggcttctctgctgcgctcccggttcgctggacgggaagaagggctgggccgtcccgtcccgtccccatcggaaccccaagtcgcgccgctgacccgtcgcagggcgagatgagcgcggacgcagcggccggggcgcccctgccccggctctgctgcctggagaagggtccgaacggctacggcttccacctgcacggggagaagggcaagttgggccagtacatccggctggtggagcccggctcgccggccgagaaggcggggctgctggcgggggaccggctggtggaggtgaacggcgaaaacgtggagaaggagacccaccagcaggtggtgagccgcatccgcgccgcactcaacgccgtgcgcctgctggtggtcgaccccgagacggacgagcagctgcagaagctcggcgtccaggtccgagaggagctgctgcgcgcccaggaagcgccggggcaggccgagccgccggccgccgccgaggtgcagggggctggcaacgaaaatgagcctcgcgaggccgacaagagccacccggagcagcgcgagcttcggcctcggctctgtaccatgaagaagggccccagtggctatggcttcaacctgcacagcgacaagtccaagccaggccagttcatccggtcagtggacccagactccccggctgaggcttcagggctccgggcccaggatcgcattgtggaggtgaacggggtctgcatggaggggaagcagcatggggacgtggtgtccgccatcagggctggcggggacgagaccaagctgctggtggtggacagggaaactgacgagttcttcaagaaatgcagagtgatcccatctcaggagcacctgaatggtcccctgcctgtgcccttcaccaatggggagatacagaaggagaacagtcgtgaagccctggcagaggcagccttggagagccccaggccagccctggtgagatccgcctccagtgacaccagcgaggagctgaattcccaagacagccccccaaaacaggactccacagcgccctcgtctacctcctcctccgaccccatcctagacttcaacatctccctggccatggccaaagagagggcccaccagaaacgcagcagcaaacgggccccgcagatggactggagcaagaaaaacgaactcttcagcaacctctgagcgccctgctgccacccagtgactggcagggccgagccagcattccaccccacctttttccttctccccaattactcccctgaatcaatgtacaaatcagcacccacatcccctttcttgacaaatgatttttctagagaactatgttcttccctgactttagggaaggtgaatgtgttcccgtcctcccgcagtcagaaaggagactctgcctccctcctcctcactgagtgcctcatcctaccgggtgtccctttgccaccctgcctgggacatcgctggaacctgcaccatgccaggatcatgggaccaggcgagagggcaccctcccttcctcccccatgtgataaatgggtccagggctgatcaaagaactctgactgcagaactgccgctctcagtggacagggcatctgttatcctgaaccttggcagacacgtcttgttttcatttgattttgttaagagtgcagtattgcagagtctagaggaatttttgtttccttgattaacatgattttcctggttgttaatccagggcatggcagtggcctcagccttaaacttttgttcctactcccaccctcagcgaactgggcagcacggggagggtttggctacccctgcccatccctgagccaggtaccaccattgtaaggaaacactttcagaaattcagctggttcctccaaaccaaaaaaaaaaaaaaaa

SEQ ID NO: 80 - DNA, 1206 bp, Homo sapiens
gttgctgtcggggagttgaaacctaattttgtggcgtagagctatgcagcttgaaatccaagtagcactaaattttattatttcgtatttgtacaataagcttcccaggagacgtgtcaacatttttggtgaagaacttgaaagacttcttaagaagaaatatgaagggcactggtatcctgaaaagccatacaaaggatcggggtttagatgtatacacataggggagaaagtggacccagtgattgaacaagcatccaaagagagtggtttggacattgatgatgttcgtggcaatctgccacaggatcttagtgtttggatcgacccatttgaggtttcttaccaaattggtgaaaagggaccagtgaaggtgctttacgtggatgataataatgaaaatggatgtgagttggataaggagatcaaaaacagctttaacccagaggcccaggtttttatgcccataagtgacccagcctcatcagtgtccagctctccatcgcctccttttggtcactctgctgctgtaagccctaccttcatgccccggtccactcagcctttaacctttaccactgccacttttgctgccaccaagttcggctctaccaaaatgaagaatagtggccgtagcaacaaggttgcacgtacttctcccatcaacctcggcttgaatgtgaatgacctcttgaagcagaaagccatctcttcctcaatgcactctctgtatgggcttggcttgggtagccagcagcagccacagcaacagcagcagccagcccagccgccaccgccaccaccaccaccacagcagcaacaacagcagaaaacctctgctctttctcctaatgccaaggaatttatttttcctaatatgcagggtcaaggtagtagtaccaatggaatgttcccaggtgacagcccccttaacctcagtcctctccagtacagtaatgcctttgatgtgtttgcagcctatggaggcctcaatgagaagtcttttgtagatggcttgaattttagcttaaataacatgcagtattctaaccagcaattccagcctgttatggctaactaaaaaaaagaaaatgtatcgtacaagttaaaatgcacgggcccaagggggattttttttttcacctccttgagaatttttttttttttaagcttatagtaaggatacattcaagcttgggttaaaaa

SEQ ID NO: 81 - DNA, 540 bp, Homo sapiens
atccctgactcggggtcgcctttggagcagagaggaggcaatggccaccatggagaacaaggtgatctgcgccctggtcctggtgtccatgctggccctcggcaccctggccgaggcccagacagagacgtgtacagtggccccccgtgaaagacagaattgtggttttcctggtgtcacgccctcccagtgtgcaaataagggctgctgtttcgacgacaccgttcgtggggtcccctggtgcttctatcctaataccatcgacgtccctccagaagaggagtgtgaattttagacacttctgcagggatctgcctgcatcctgacggggtgccgtccccagcacggtgattagtcccagagctcggctgccacctccaccggacacctcagacacgcttctgcagctgtgcctcggctcacaacacagattgactgctctgactttgactactcaaaattggcctaaaaattaaaagagatcgatattaaaaaaaaaaaaaaaaaaaaaaaaaaaaaaaaaaaaaaaaaaaaaaaaaa

SEQ ID NO: 82 - DNA, 607 bp, Homo sapiens
  misc_feature (457)..(457): n is a, c, g, or t
  misc_feature (479)..(479): n is a, c, g, or t
  misc_feature (541)..(541): n is a, c, g, or t
  misc_feature (562)..(562): n is a, c, g, or t
  misc_feature (570)..(570): n is a, c, g, or t
  misc_feature (576)..(576): n is a, c, g, or t
  misc_feature (583)..(583): n is a, c, g, or t
ctcactgatagctgatcacattaaacaggtacaggtgctaagaaagtttaagactgatcttttggcaatgacagtttaggttaactctgtttggaattcctaaaaataaaaagaaatcccttaaaaaaggctgacaaactgaccacttggccttgaatcgactgttagggtcacacctgccaatgccaggggacatcacaaaaaaatagagaatgccaagataaaaagttcactgcattcaatttggcctaatttcttgataatagtttcctattagattttccgattaatactgatggctcttacctaggctgtgagagtttttttttttttttttttttgcaattttataactttatttgatctgacgatcagcgattagttctcatccacattgactgtctgtagatttttgaaagtgggtaacagggtacataggtaaccaaagtatatagcntatttgggtgaatcttcatccncattacgttttctggacagccgcacacgggattcgggatggcacattccctattcccttggnccagacagctttgttgagccnggggtcangcgccnacccggngtcccactcctcagggaaattccg

SEQ ID NO: 83 - DNA, 4012 bp, Homo sapiens
tgggtttttaccagcaacaaaaaatttattgaatgagaagaaccatggtgtcctccacacatctgtagtcctcctcacagaaatgtgtgagcgaagcccagacatgcttgcgcatttcagagagaatgaaaagcttgtgccccaattagttcgtattttaaagaacctcatcatgtccggatattcaccaggacatgatgtttctggtatcagtgacccctttttgcaggtacgaattttgcggttattaagaattttaggacgaaatgatgatgattcaagtgaagctatgaatgatatattagcacaggttgccactaatactgagactagtaaaaatgtaggaaatgctattctttatgaaacggttttgactatcatggatattaagtcagagagtggattgcgagtcctagccataaatatcctgggtcgtttcttattgaacaatgacaagaatattaggtatgtggctctgacatctttgttgaagactgtacagacagatcataatgcagtacagaggcacagaagcacaattgtggactgtcttaaagatttggatgtctcaataaaacggcgtgcaatggaattgagttttgccctggtaaatgggaataatatccgaggcatgatgaaagaattactttattttctggattcgtgtgagccagaatttaaagcagactgtgcatctggaatctttcttgctgcagaaaagtatgcaccttccaaacgatggcatatagacacaattatgcgtgttttgacaacggcaggaagttatgttcgtgatgatgcagtccccaatttaatccagttaataactaatagtgtggagatgcatgcctatactgtccagcgcctgtacaaagcaattcttggtgattattctcaacaacctttggtacaagtggctgcatggtgtataggtgaatatggtgatcttcttgtatctggccagtgtgaagaggaagagcctattcaggtaacagaggatgaagtgttggatattttagaaagtgtcctaatctctaatatgtccacctctgtgacacgaggttatgccctcactgccattatgaagctttccactcgattcacttgtactgtaaaccgaattaagaaagtggtttccatctacggaagcagcattgatgtggaactccagcggagggcagtagaatataatgcacttttcaagaaatatgaccacatgaggtctgccctacttgagagaatgcctgtcatggaaaaagtgaccacaaatggccctactgagattgtgcagacaaatggagagacagaaccagctccactagagaccaaaccgccaccctctgggccacagcccaccagccaggccaatgatttattggatttgttgggaggaaatgacataacacctgttattccaactgcgcctacaagcaaaccatcttctgctggtggagaacttcttgatttgctgggagacatcaaccttacagggtctcactctgtcagccaggctggagtgcagtgggattatctcggctcacttcaacctctgcctcctgcgttcaggtgagcctcctgcctcggcctcctgagtagctgggattataggcgaatgccaccatgcccggctaattttttgtatttttagtagagacggggttttgctgtcttctttaaggggataatgaagagttaaagcacacatgaccttgagtaaaaaatagacataggataacaagttggatggttagctaagctcattcccacaggctgattttttttttcctaatacagtggagtcacagagtataggatttatgtctgtgtcttaacaaaatttcaaaatgttacttgtcatgtacttatgaatcatttacaaatggtcaatttcaaatcctcaaatgtcaaagctgtactggataaccggcaaagaaaaaacaaccccacagttaaaccatagcatatacttcacctaatatgttagtatttccatgttaatatatatagccttcataattataattttaggtgactaatactttatcaacaaatttgctctgtttactcagttcgttagtattgggtagtttggcttttttttttggtttttttgaaacggaatcttgctttgttgcccgggctggagtgcaacagcacgatcgcggctcactgcaacctctgcctcccgggttcaagtgattctcctgcctcagcctcccgagtagctgggatttataggcacgtgccaccatgcccagctaatttttgtatttttttatttgagatggggtttcaccatgttggccaggctggtcttgaactcctgacctcggatgatcctcccgccttggcctcccaaagtgctgggattacaggcatgagtcaccgcacccagccagtatggggtattttgtttctagatttttctacctagcggccccaacaaatattacatcaatttgttcttattttagattaatttgttagactaagtgacttagtctttctgaatctggttaaaattaggatgattaatacttactccataagatatttgtgaggcccattgacctattcagtgcatgatacatagtaggcacttggtaaatattatttaccttttcctcaatttatatgtttaaccgcacagtcataagcattgtatattatcattttaaaaagccctattgggtgaaaatttggtcctattatattttatttttattattatttttttaaattttgtagccctctgccaggcttggtcagcagagagaggccctattattttttgatcacagagcgagactccatctcaaaaaaaaaaaaaaaaaaaaaaattattctgtaccatcacaacttttcacaacgatggcaagccttatgtcttgggagcctgttttgctaggcaaagttacaagtgacctaatgggagctcaaatgtgtgtgtgtctctctgtgtgtttgtgtgtgtgtgtgcactcaagacctctaacagcctcgaagcctggggtggcatcccggccttgccattagcatgcctcatgcatcatcagatgacaaggacaaccctcatgacgaagcaacatgaattagggggcctcttggccttggtccaaaattgtcaatcagaaatgaacataaaggactccagagcagtgggactgtctgtcaaaagactctgtatatcttttgcggatgagttttgtgagagaacagagagaccattgtacctggcacaagggctcttcatgaaaagggagacttactgggaggtgcaagacagtggcatttctcctctcctcttgctgctcagcacagccctggattgcagccccgaggctgagaccagacaaagcccgggaggcagaaagatgctccaagaaccaacactatcaatgtctttgcaaatcctcacaggattcctgtgggtccagctttggaactgggaaacctttcttcggatccgcactcattccactgatgccagctgcccctgaaggatgccagtactgtggtgtgtgagtctcagcagccgcccacacgctcctaactctgctgcatggcagatgcctaggtggaaatagcaaaaacaaggcccgggctggggccagggccagaggggaaggccctggattctcactcatgtgagatcttgaatctctttctttgttctgtttgtttagttagtatcatctggtaaaatagttaaaaaacaacaaaaaactctgtatctgtttctagcatgtgctgcattgactctattaatcacatttcaaattcaccctacattcctctcctcttcactagcctctctgaaggtgtcctggccagccctggagaagcactggtgtctgcagcacccctcagttcctgtgcctcagcccacaggccactgtgataatggtctgtttagcacttctgtatttattgtaagaatgattataatgaagatacacactgtaactgcaagaaattataaatgtttttcacaaaaaaaaaaaaaaaaaaa

SEQ ID NO: 84 - DNA, 6491 bp, Homo sapiens
ccgccccggcgcccaggctcggtgctggagagtcatgcctgtgagccctgggcacctcctgatgtcctgcgaggtcacggtgttcccaaacctcagggttgccctgccccactccagaggctctcaggccccaccccggagccctctgtgcggagccgcctcctcctggccagttccccagtagtcctgaagggagacctgctgtgtggagcctcttctgggacccagccatgagtgtggagctgagcaactgaacctgaaactcttccactgtgagtcaaggaggcttttccgcacatgaaggacgctgagcgggaaggactcctctctgcctgcagttgtagcgagtggaccagcaccaggggctctctagactgcccctcctccatcgccttccctgcctctccaggacagagcagccacgtctgcacacctcgccctctttacactcagttttcagagcacgtttctcctatttcctgcgggttgcagcgcctacttgaacttactcagaccacctacttctctagcagcactgggcgtccctttcagcaagacgatggctgtgctcaggcagctggcgctcctcctctggaagaactacaccctgcagaagcggaaggtcctggtgacggtcctggaactcttcctgccattgctgtttcctgggatcctcatctggctccgcttgaagattcagtcggaaaatgtgcccaacgccaccatctacccgggccagtccatccaggagctgcctctgttcttcaccttccctccgccaggagacacctgggagcttgcctacatcccttctcacagtgacgctgccaagaccgtcactgagacagtgcgcagggcacttgtgatcaacatgcgagtgcgcggctttccctccgagaaggactttgaggactacattaggtacgacaactgctcgtccagcgtgctggccgccgtggtcttcgagcaccccttcaaccacagcaaggagcccctgccgctggcggtgaaatatcacctacggttcagttacacacggagaaattacatgtggacccaaacaggctcctttttcctgaaagagacagaaggctggcacactacttcccttttcccgcttttcccaaacccaggaccaagggaactaacatcccctgatggcggagaacctgggtacatccgggaaggcttcctggccgtgcagcatgctgtggaccgggccatcatggagtaccatgccgatgccgccacacgccagctgttccagagactgacggtgaccatcaagaggttcccgtacccgccgttcatcgcagaccccttcctcgtggccatccagtaccagctgcccctgctgctgctgctcagcttcacctacaccgcgctcaccattgcccgtgctgtcgtgcaggagaaggaaaggaggctgaaggagtacatgcgcatgatggggctcagcagctggctgcactggagtgcctggttcctcttgttcttcctcttcctcctcatcgccgcctccttcatgaccctgctcttctgtgtcaaggtgaagccaaatgtagccgtgctgtcccgcagcgacccctccctggtgctcgccttcctgctgtgcttcgccatctctaccatctccttcagcttcatggtcagcaccttcttcagcaaagccaacatggcagcagccttcggaggcttcctctacttcttcacctacatcccctacttcttcgtggcccctcggtacaactggatgactctgagccagaagctctgctcctgcctcctgtctaatgtcgccatggcaatgggagcccagctcattgggaaatttgaggcgaaaggcatgggcatccagtggcgagacctcctgagtcccgtcaacgtggacgacgacttctgcttcgggcaggtgctggggatgctgctgctggactctgtgctctatggcctggtgacctggtacatggaggccgtcttcccagggcagttcggcgtgcctcagccctggtacttcttcatcatgccctcctattggtgtgggaagccaagggcggttgcagggaaggaggaagaagacagtgaccccgagaaagcactcagaaacgagtactttgaagccgagccagaggacctggtggcggggatcaagatcaagcacctgtccaaggtgttcagggtgggaaataaggacagggcggccgtcagagacctgaacctcaacctgtacgagggacagatcaccgtcctgctgggccacaacggtgccgggaagaccaccaccctctccatgctcacaggtctctttccccccaccagtggacgggcatacatcagcgggtatgaaatttcccaggacatggttcagatccggaagagcctgggcctgtgcccgcagcacgacatcctgtttgacaacttgacagtcgcagagcacctttatttctacgcccagctgaagggcctgtcacgtcagaagtgccctgaagaagtcaagcagatgctgcacatcatcggcctggaggacaagtggaactcacggagccgcttcctgagcgggggcatgaggcgcaagctctccatcggcatcgccctcatcgcaggctccaaggtgctgatactggacgagcccacctcgggcatggacgccatctccaggagggccatctgggatcttcttcagcggcagaaaagtgaccgcaccatcgtgctgaccacccacttcatggacgaggctgacctgctgggagaccgcatcgccatcatggccaagggggagctgcagtgctgcgggtcctcgctgttcctcaagcagaaatacggtgccggctatcacatgacgctggtgaaggagccgcactgcaacccggaagacatctcccagctggtccaccaccacgtgcccaacgccacgctggagagcagcgctggggccgagctgtctttcatccttcccagagagagcacgcacaggtttgaaggtctctttgctaaactggagaagaagcagaaagagctgggcattgccagctttggggcatccatcaccaccatggaggaagtcttccttcgggtcgggaagctggtggacagcagtatggacatccaggccatccagctccctgccctgcagtaccagcacgagaggcgcgccagcgactgggctgtggacagcaacctctgtggggccatggacccctccgacggcattggagccctcatcgaggaggagcgcaccgctgtcaagctcaacactgggctcgccctgcactgccagcaattctgggccatgttcctgaagaaggccgcatacagctggcgcgagtggaaaatggtggcggcacaggtcctggtgcctctgacctgcgtcaccctggccctcctggccatcaactactcctcggagctcttcgacgaccccatgctgaggctgaccttgggcgagtacggcagaaccgtcgtgcccttctcagttcccgggacctcccagctgggtcagcagctgtcagagcatctgaaagacgcactgcaggctgagggacaggagccccgcgaggtgctcggtgacctggaggagttcttgatcttcagggcttctgtggaggggggcggctttaatgagcggtgccttgtggcagcgtccttcagagatgtgggagagcgcacggtcgtcaacgccttgttcaacaaccaggcgtaccactctccagccactgccctggccgtcgtggacaaccttctgttcaagctgctgtgcgggcctcacgcctccattgtggtctccaacttcccccagccccggagcgccctgcaggctgccaaggaccagtttaacgagggccggaagggattcgacattgccctcaacctgctcttcgccatggcattcttggccagcacgttctccatcctggcggtcagcgagagggccgtgcaggccaagcatgtgcagtttgtgagtggagtccacgtggccagtttctggctctctgctctgctgtgggacctcatctccttcctcatccccagtctgctgctgctggtggtgtttaaggccttcgacgtgcgtgccttcacgcgggacggccacatggctgacaccctgctgctgctcctgctctacggctgggccatcatccccctcatgtacctgatgaacttcttcttcttgggggcggccactgcctacacgaggctgaccatcttcaacatcctgtcaggcatcgccaccttcctgatggtcaccatcatgcgcatcccagctgtaaaactggaagaactttccaaaaccctggatcacgtgttcctggtgctgcccaaccactgtctggggatggcagtcagcagtttctacgagaactacgagacgcggaggtactgcacctcctccgaggtcgccgcccactactgcaagaaatataacatccagtaccaggagaacttctatgcctggagcgccccgggggtcggccggtttgtggcctccatggccgcctcagggtgcgcctacctcatcctgctcttcctcatcgagaccaacctgcttcagagactcaggggcatcctctgcgccctccggaggaggcggacactgacagaattatacacccggatgcctgtgcttcctgaggaccaagatgtagcggacgagaggacccgcatcctggcccccagcccggactccctgctccacacacctctgattatcaaggagctctccaaggtgtacgagcagcgggtgcccctcctggccgtggacaggctctccctcgcggtgcagaaaggggagtgcttcggcctgctgggcttcaatggagccgggaagaccacgactttcaaaatgctgaccggggaggagagcctcacttctggggatgcctttgtcgggggtcacagaatcagctctgatgtcggaaaggtgcggcagcggatcggctactgcccgcagtttgatgccttgctggaccacatgacaggccgggagatgctggtcatgtacgctcggctccggggcatccctgagcgccacatcggggcctgcgtggagaacactctgcggggcctgctgctggagccacatgccaacaagctggtcaggacgtacagtggtggtaacaagcggaagctgagcaccggcatcgccctgatcggagagcctgctgtcatcttcctggacgagccgtccactggcatggaccccgtggcccggcgcctgctttgggacaccgtggcacgagcccgagagtctggcaaggccatcatcatcacctcccacagcatggaggagtgtgaggccctgtgcacccggctggccatcatggtgcaggggcagttcaagtgcctgggcagcccccagcacctcaagagcaagttcggcagcggctactccctgcgggccaaggtgcagagtgaagggcaacaggaggcgctggaggagttcaaggccttcgtggacctgacctttccaggcagcgtcctggaagatgagcaccaaggcatggtccattaccacctgccgggccgtgacctcagctgggcgaaggttttcggtattctggagaaagccaaggaaaagtacggcgtggacgactactccgtgagccagatctcgctggaacaggtcttcctgagcttcgcccacctgcagccgcccaccgcagaggaggggcgatgaggggtggcggctgtctcgccatcaggcagggacaggacgggcaagcagggcccatcttacatcctctctctccaagtttatctcatcctttatttttaatcacttttttctatgatggatatgaaaaattcaaggcagtatgcacagaatggacgagtgcagcccagccctcatgcccaggatcagcatgcgcatctccatgtctgcatactctggagttcactttcccagagctggggcaggccgggcagtctgcgggcaagctccggggtctctgggtggagagctgacccaggaagggctgcagctgagctgggggttgaatttctccaggcactccctggagagaggacccagtgacttgtccaagtttacacacgacactaatctcccctggggaggaagcgggaagccagccaggttgaactgtagcgaggcccccaggccgccaggaatggaccatgcagatcactgtcagtggagggaagctgctgactgtgattaggtgctggggtcttagcgtccagcgcagcccgggggcatcctggaggctctgctcccttagggcatggtagtcaccgcgaagccgggcaccgtcccacagcatctcctagaagcagccggcacaggagggaaggtggccaggctcgaagcagtctctgtttccagcactgcaccctcaggaagtcgcccgccccaggacacgcagggaccaccctaagggctgggtggctgtctcaaggacacattgaatacgttgtgaccatccagaaaataaatgctgaggggacacaaaaaaaaaaaaaaaaaaaaaaaa

SEQ ID NO: 85 - DNA, 2930 bp, Homo sapiens
gaattccggtttcttcctaaaaaatgtctgatggccgctttctcggtcggcaccgccatgaatgccagcagttactctgcagagatgacggagcccaagtcggtgtgtgtctcggtggatgaggtggtgtccagcaacatggaggccactgagacggacctgctgaatggacatctgaaaaaagtagataataacctcacggaagcccagcgcttctcctccttgcctcggagggcagctgtgaacattgaattcagggacctttcctattcggttcctgaaggaccctggtggaggaagaaaggatacaagaccctcctgaaaggaatttccgggaagttcaatagtggtgagttggtggccattatgggtccttccggggccgggaagtccacgctgatgaacatcctggctggatacagggagacgggcatgaagggggccgtcctcatcaacggcctgccccgggacctgcgctgcttccggaaggtgtcctgctacatcatgcaggatgacatgctgctgccgcatctcactgtgcaggaggccatgatggtgtcggcacatctgaagcttcaggagaaggatgaaggcagaagggaaatggtcaaggagatactgacagcgctgggcttgctgtcttgcgccaacacgcggaccgggagcctgtcaggtggtcagcgcaagcgcctggccatcgcgctggagctggtgaacaaccctccagtcatgttcttcgatgagcccaccagcggcctggacagcgcctcctgcttccaggtggtctcgctgatgaaagggctcgctcaagggggtcgctccatcatttgcaccatccaccagcccagcgccaaactcttcgagctgttcgaccagctttacgtcctgagtcaaggacaatgtgtgtaccggggaaaagtctgcaatcttgtgccatatttgagggatttgggtctgaactgcccaacctaccacaacccagcagattttgtcatggaggttgcatccggcgagtacggtgatcagaacagtcggctggtgagagcggttcgggagggcatgtgtgactcagaccacaagagagacctcgggggtgatgccgaggtgaacccttttctttggcaccgcccctctgaagaggtaaagcagacaaaacgattaaaggggttgagaaaggactcctcgtccatggaaggctgccacagcttctctgccagctgcctcacgcagttctgcatcctcttcaagaggaccttcctcagcatcatgagggactcggtcctgacacacctgcgcatcacctcgcacattgggatcggcctcctcattggcctgctgtacttggggatcgggaacgaaaccaagaaggtcttgagcaactccggcttcctcttcttctccatgctgttcctcatgttcgcggccctcatgcctactgttctgacatttcccctggagatgggagtctttcttcgggaacacctgaactactggtacagcctgaaggcctactacctggccaagaccatggcagacgtgccctttcagatcatgttcccagtggcctactgcagcatcgtgtactggatgacgtcgcagccgtccgacgccgtgcgctttgtgctgtttgccgcgctgggcaccatgacctccctggtggcacagtccctgggcctgctgatcggagccgcctccacgtccctgcaggtggccactttcgtgggcccagtgacagccatcccggtgctcctgttctcggggttcttcgtcagcttcgacaccatccccacgtacctacagtggatgtcctacatctcctatgtcaggtatgggttcgaaggggtcatcctctccatctatggcttagaccgggaagatctgcactgtgacatcgacgagacgtgccacttccagaagtcggaggccatcctgcgggagctggacgtggaaaatgccaagctgtacctggacttcatcgtactcgggattttcttcatctccctccgcctcattgcctatttggtcctcaggtacaaaatccgggcagagaggtaaaacacctgaatgccaggaaacaggaagattagacactgtggccgagggcacgtctagaatcgaggaggcaagcctgtgcccgaccgacgacacagagactcttctgatccaacccctagaaccgcgttgggtttgtgggtgtctcgtgctcagccactctgcccagctgggttggatcttctctccattcccctttctagctttaactaggaagatgtaggcagattggtggttttttttttttttttaacatacagaattttaaataccacaactggggcagaatttaaagctgcaacacagctggtgatgagaggcttcctcagtccagtcgctccttagcaccaggcaccgtgggtcctggatggggaactgcaagcagcctctcagctgatggctgcacagtcagatgtctggtggcagagagtccgagcatggagcgattccattttatgactgttgtttttcacattttcatctttctaaggtgtgtctcttttccaatgagaagtcatttttgcaagccaaaagtcgatcaatcgcattcattttaagaaattatacctttttagtacttgctgaagaatgattcagggtaaatcacatactttgtttagagaggcgaggggtttaacccgagtcacccagctggtctcatacatagacagcacttgtgaaggattgaatgcaggttccaggtggagggaagacgtggacaccatctccactgagccatgcagacatttttaaaagctatacacaaaattgtgagaagacattggccaactctttcaaagtctttctttttccacgtgcttcttattttaagcgaaatatattgtttgtttcttcctaaaaaaaaaaaaaaaaaaaaa

SEQ ID NO: 86 - DNA, 812 bp, Homo sapiens
tttttttttttttttttttttttcccaagtcgacttgactttgcttttttccccccaagtagaactaatgctagcttccagcttgaaagtaaaacyccagtgtggagtgaattttgtgtctaattataaacctgtaaccaaaactcagacatctggtactggtctttgcattgagattggtccctgtaaaaccccctttaaaagcatattgcatttagtacagagctcttttttgaaatgaaggctggagatgtgcatttttcacggtgttaactggttgtatcttattagcaaggagattggggttttgagtgtttgcgtgggtggtttcaatttgccagggaacagtggcaggctgccagcaaggcagtaagaagctcttggcagccaaatgggtgcattcagggctgatttatagagacccttggcttctccttctcctactccctgtctttctggcattttgtagcttgttagattttctgccagaggggtgggtcagagcagtggaggggagacatcgcccatgtkcttctgctactggtccttgggctgggtggttggtagaggagatgttgacactatgagcyaagggttggcttttgtaattacctgaatctgaaaggaatgcctaaggttaccttggggtttctcttctggtgagatagggttcctggtttgagtwagttaatgtcctggatatttcttgtggsagggggtggtcaaagagcctgattgctgacccagtytcaggcctgtggtcgatgacctctcggtaatttcaaagggggctggarggggatatttgactt

SEQ ID NO: 87 - DNA, 2775 bp, Homo sapiens
gtactcgccacggcacccaggctgcgcgcacgcggtcccggtgtgcagctggagagcgagcggccaccgggagcccccggcacagcccgcgcccgccccgcaggagcccgcgaagatgccccggcgcagcctgcacgcggcggccgtgctcctgctggtgatcttaaaggaacagccttccagcccggccccagtgaacggttccaagtggacttattttggtcctgatggggagaatagctggtccaagaagtacccgtcgtgtgggggcctgctgcagtcccccatagacctgcacagtgacatcctccagtatgacgccagcctcacgcccctcgagttccaaggctacaatctgtctgccaacaagcagtttctcctgaccaacaatggccattcagtgaagctgaacctgccctcggacatgcacatccagggcctccagtctcgctacagtgccacgcagctgcacctgcactgggggaacccgaatgacccgcacggctctgagcacaccgtcagcggacagcacttcgccgccgagctgcacattgtccattataactcagacctttatcctgacgccagcactgccagcaacaagtcagaaggcctcgctgtcctggctgttctcattgagatgggctccttcaatccgtcctatgacaagatcttcagtcaccttcaacatgtaaagtacaaaggccaggaagcattcgtcccgggattcaacattgaagagctgcttccggagaggaccgctgaatattaccgctaccgggggtccctgaccacacccccttgcaaccccactgtgctctggacagttttccgaaaccccgtgcaaatttcccaggagcagctgctggctttggagacagccctgtactgcacacacatggacgacccttcccccagagaaatgatcaacaacttccggcaggtccagaagttcgatgagaggctggtatacacctccttctcccaagtgcaagtctgtactgcggcaggactgagtctgggcatcatcctctcactggccctggctggcattcttggcatctgtattgtggtggtggtgtccatttggcttttcagaaggaagagtatcaaaaaaggtgataacaagggagtcatttacaagccagccaccaagatggagactgaggcccacgcttgaggtccccggagctcccgggcacatccaggaaggaccttgctttggaccctacacacttcggctctctggacacttgcgacacctcaaggtgttctctgtagctcaatctgcaaacatgccaggcctcagggatcctctgctgggtgcctccttgccttgggaccatggccaccccagagccatccgatcgatggatgggatgcactctcagaccaagcagcaggaattcaaagctgcttgctgtaactgtgtgagattgtgaagtggtctgaattctggaatcacaaaccaagccatgctggtgggccattaatggttggaaaacactttcatccggggctttgccagagcgtgctttcaagtgtcctggaaagtctgctgcttctccaagctttcagacaagaatgtgcactctctgcttaggttttgcttgggaaactcaacttctttcctctggagacggggcatctccctctgatttccttctgctatgacaaaacctttaatctgcaccttacaactcggggacaaatggggacaggaaggatcaagttgtagagagaaaaaagaaaacaagagatatacattgtgatatattagggacactttcacagtcctgtcctctggatcacagacactgcacagaccttagggaatggcaggttcaagttccacttcttggtggggatgagaagggagagagagctagagggacaaagagaatgagaagacatggatgatctgggagagtctcactttggaatcagaattggaatcacattctgtttatcaagccataatgtaaggacagaataatacaatattaagtccaaatccaacctcctgtcagtggagcagttatgttttatactctacagattttacaaataatgaggctgttccttgaaaatgtgttgttgctgtgtcctggaggagacatgagttccgagatgacccaatctgcctttgaatctggaggaaataggcagaaacaaaatgactgtagaacttattctctgtaggccaaatttcatttcagccacttctgcaggatccctactgccaacctggaatggagacttttatctacttctctctctctgaagatgtcaaatcgtggtttagatcaaatatatttcaagctataaaagcaggaggttatctgtgcagggggctggcatcatgtatttaggggcaagtaataatggaatgctactaagatactccatattcttccccgaatcacacagacagtttctgacaggcgcaactcctccattttcctcccgcaggtgagaaccctgtggagatgagtcagtgccatgactgagaaggaaccgacccctagttgagagcaccttgcagttccccgagaactttctgattcacagtctcattttgacagcatgaaatgtcctcttgaagcatagctttttaaatatctttttccttctactcctccctctgactctaagaattctctcttctggaatcgcttgaacccaggaggcggaggttgcagtaagccaaggtcatgccactgcactctagcctgggtgacagagcgagactccatctcaaaaaaaaaaaaaaaa

SEQ ID NO: 88 - DNA, 848 bp, Homo sapiens
gacatggagctgttcctcgcgggccgccgggtgctggtcaccggggcaggcaaaggtatagggcgcggcacggtccaggcgctgcacgcgacgggcgcgcgggtggtggctgtgagccggactcaggcggatcttgacagccttgtccgcgagtgcccggggatagaacccgtgtgcgtggacctgggtgactgggaggccaccgagcgggcgctgggcagcgtgggccccgtggacctgctggtgaacaacgccgctgtcgccctgctgcagcccttcctggaggtcaccaaggaggcctttgacagatcctttgaggtgaacctgcgtgcggtcatccaggtgtcgcagattgtggccaggggcttaatagcccggggagtcccaggggccatcgtgaatgtctccagccagtgctcccagcgggcagtaactaaccatagcgtctactgctccaccaagggtgccctggacatgctgaccaaggtgatggccctagagctcgggccccacaagatccgagtgaatgcagtaaaccccacagtggtgatgacgtccatgggccaggccacctggagtgacccccacaaggccaagactatgctgaaccgaatcccacttggcaagtttgctgaggtagagcacgtggtgaacgccatcctctttctgctgagtgaccgaagtggcatgaccacgggttccactttgccggtggaagggggcttctgggcctgctgagctccctccacacacctcaagccccatgccgtgctcatcctacccccaatccctccaataaacctgattctgctgcccaaaaaaaaaaaaaaaaaaaaaaaaaaaaaaaa

SEQ ID NO: 89 - DNA, 2546 bp, Homo sapiens
gctgccgctgccgcacctccgtagctgactcggtactctctgaagatggcagaagctcaccaagctgtggcctttcagttcacggtcactccggacgggattgacctgcggctgagccatgaagctcttagacaaatctatctctctggacttcattcctggaaaaagaagttcatcagattcaagaacggcatcatcactggcgtgtacccggcaagcccctccagttggcttatcgtggtggtgggcgtgatgacaacgatgtacgccaagatcgacccctcgttaggaataattgcaaaaatcaatcggactctggaaacggccaactgcatgtccagccagacgaagaacgtggtcagcggcgtgctgtttggcaccggcctgtgggtggccctcatcgtcaccatgcgctactccctgaaagtgctgctctcctaccacgggtggatgttcactgagcacggcaagatgagtcgtgccaccaagatctggatgggtatggtcaagatcttttcaggccgaaaacccatgttgtacagcttccagacatcgctgcctcgcctgccggtcccggctgtcaaagacactgtgaacaggtatctacagtcggtgaggcctcttatgaaggaagaagacttcaaacggatgacagcacttgctcaagattttgctgtcggtcttggaccaagattacagtggtatttgaagttaaaatcctggtgggctacaaattacgtgagcgactggtgggaggagtacatctacctccgaggacgagggccgctcatggtgaacagcaactattatgccatggatctgctgtatatccttccaactcacattcaggcagcaagagccggcaacgccatccatgccatcctgctttacaggcgcaaactggaccgggaggaaatcaaaccaattcgtcttttgggatccacgattccactctgctccgctcagtgggagcggatgtttaatacttcccggatcccaggagaggagacagacaccatccagcacatgagagacagcaagcacatcgtcgtgtaccatcgaggacgctacttcaaggtctggctctaccatgatgggcggctgctgaagccccgggagatggagcagcagatgcagaggatcctggacaatacctcggagcctcagcccggggaggccaggctggcagccctcaccgcaggagacagagttccctgggccaggtgtcgtcaggcctattttggacgtgggaaaaataagcagtctcttgatgctgtggagaaagcagcgttcttcgtgacgttagatgaaactgaagaaggatacagaagtgaagacccggatacgtcaatggacagctacgccaaatctctactacacggccgatgttacgacaggtggtttgacaagtcgttcacgtttgttgtcttcaaaaacgggaagatgggcctcaacgctgaacactcctgggcagatgcgccgatcgtggcccacctttgggagtacgtcatgtccattgacagcctccagctgggctatgcggaggatgggcactgcaaaggcgacatcaatccgaacattccgtaccccaccaggctgcagtgggacatcccgggggaatgtcaagaggttatagagacctccctgaacaccgcaaatcttctggcaaacgacgtggatttccattccttcccattcgtagcctttggtaaaggaatcatcaagaaatgtcgcacgagcccagacgcctttgtgcagctggccctccagctggcgcactacaaggacatgggcaagttttgcctcacatacgaggcctccatgacccggctcttccgagaggggaggacggagaccgtgcgctcctgcaccactgagtcatgcgacttcgtgcgggccatggtggacccggcccagacggtggaacagaggctgaagttgttcaagttggcgtctgagaagcatcagcatatgtatcgcctcgccatgaccggctctgggatcgatcgtcacctcttctgcctttacgtggtgtctaaatatctcgctgtggagtcccctttccttaaggaagttttatctgagccttggagattatcaacaagccagacccctcagcagcaagtggagctgtttgacttggagaataacccagagtacgtgtccagcggagggggctttggaccggttgctgatgacggctatggtgtgtcgtacatccttgtgggagagaacctcatcaatttccacatttcttccaagttctcttgccctgagacggggattataagtcaaggaccaagttcagatacttgagacaaagtggaaagtctcagcatatggaaacaaggccttggaggagaccatggacatcaccaagttcatgtgctgggctggaaagaaaagcctgttgattttcacttgctgtgcatttattcatccattccattgcctcaatgctgagaacagtgcctgacacataaaagatgctcaataaatatgttaaaagtaaaaaaaaaaaaaaaaaaaaaaaaaaaaaaaaaaaa

SEQ ID NO: 90 - DNA, 2566 bp, Homo sapiens
cgtcgccgtccccgtctcctgccaggcgcggagccctgcgagccgcgggtgggccccaggcgcgcagacatgggctgctccgccaaagcgcgctgggctgccggggcgctgggcgtcgcggggctactgtgcgctgtgctgggcgctgtcatgatcgtgatggtgccgtcgctcatcaagcagcaggtccttaagaacgtgcgcatcgaccccagtagcctgtccttcaacatgtggaaggagatccctatccccttctatctctccgtctacttctttgacgtcatgaaccccagcgagatcctgaagggcgagaagccgcaggtgcgggagcgcgggccctacgtgtacagggagtccaggcacaaaagcaacatcaccttcaacaacaacgacaccgtgtccttcctcgagtaccgcaccttccagttccagccctccaagtcccacggctcggagagcgactacatcgtcatgcccaacatcctggtcttgggtgcggcggtgatgatggagaataagcccatgaccctgaagctcatcatgaccttggcattcaccaccctcggcgaacgtgccttcatgaaccgcactgtgggtgagatcatgtggggctacaaggacccccttgtgaatctcatcaacaagtactttccaggcatgttccccttcaaggacaagttcggattatttgctgagctcaacaactccgactctgggctcttcacggtgttcacgggggtccagaacatcagcaggatccacctcgtggacaagtggaacgggctgagcaaggttgacttctggcattccgatcagtgcaacatgatcaatggaacttctgggcaaatgtggccgcccttcatgactcctgagtcctcgctggagttctacagcccggaggcctgccgatccatgaagctaatgtacaaggagtcaggggtgtttgaaggcatccccacctatcgcttcgtggctcccaaaaccctgtttgccaacgggtccatctacccacccaacgaaggcttctgcccgtgcctggagtctggaattcagaacgtcagcacctgcaggttcagtgcccccttgtttctctcccatcctcacttcctcaacgccgacccggttctggcagaagcggtgactggcctgcaccctaaccaggaggcacactccttgttcctggacatccacccggtcacgggaatccccatgaactgctctgtgaaactgcagctgagcctctacatgaaatctgtcgcaggcattggacaaactgggaagattgagcctgtggtcctgccgctgctctggtttgcagagagcggggccatggagggggagactcttcacacattctacactcagctggtgttgatgcccaaggtgatgcactatgcccagtacgtcctcctggcgctgggctgcgtcctgctgctggtccctgtcatctgccaaatccggagccaagagaaatgctatttattttggagtagtagtaaaaagggctcaaaggataaggaggccattcaggcctattctgaatccctgatgacatcagctcccaagggctctgtgctgcaggaagcaaaactgtagggtcctgaggacaccgtgagccagccaggcctggccgctgggcctgaccggccccccagcccctacaccccgcttctcccggactctcccagcagacagccccccagccccacagcctgagcctcccagctgccatgtgcctgttgcacacctgcacacacgccctggcacacatacacacatgcgtgcaggcttgtgcagacactcagggatggagctgctgctgaagggacttgtagggagaggctcgtcaacaagcactgttctggaaccttctctccacgtggcccacaggctgaccacaggggctgtgggtcctgcgtccccttcctcgggtgagcctggcctgtcccgttcagccgttgggccaggcttcctcccctccaaggtgaaacactgcagtcccggtgtggtggctccccatgcaggacgggccaggctgggagtgccgccttcctgtgccaaattcagtggggactcagtgcccaggccctggcacgagctttggccttggtctacctgccaggccaggcaaagcgcctttacacaggcctcggaaaacaatggagtgagcacaagatgccctgtgcagctgcccgagggtctccgcccaccccggccggactttgatccccccgaagtcttcacaggcactgcatcgggttgtctggcgcccttttcctccagcctaaactgacatcatcctatggactgagccggccactctctggccgaagtggcgcaggctgtgcccccgagctgcccccaccccctcacagggtccctcagattataggtgcccaggctgaggtgaagaggcctgggggccctgccttccgggcgctcctggaccctggggcaaacctgtgacccttttctactggaatagaaatgagttttatcatctttgaaaaataattcactcttgaagtaataaacgtttaaaaaaatggaaaaaaaaaaaaaa

SEQ ID NO: 91 - DNA, 2056 bp, Homo sapiens
tcgcagacagctcgggggaacagtggcggcttcggccggcggtccttgcgctccccaacagcggcgcgggcgggtgagccgtcggggcacagtcccggtgctcttctgtttctcagtcttcgcgcgaccctcgtgcggtgccacacggggcgggctacgagctgctcatccagaagttcctcagcctgtacggcgaccagatcgacatgcaccgcaaattcgtggtgcagctgttcgccgaggagtggggccagtacgtggacttgcccaagggtttcgcggtgagcgagcgctgcaaggtgcgcctcgtgccgctgcagatccagctcactaccctgggaaatcttacaccttcaagcactgtgtttttctgctgtgatatgcaggaaaggttcagaccagccatcaagtattttggggatattattagcgtgggacagagattgttgcaaggggcccggattttaggaattcctgttattgtaacagaacaataccctaaaggtcttgggagcacggttcaagaaattgatttaacaggtgtaaaactggtacttccaaagaccaagttttcaatggtattaccagaagtagaagcggcattagcagagattcccggagtcaggagtgttgtattatttggagtagaaactcatgtgtgcatccaacaaactgccctggagctagttggccgaggagtcgaggttcacattgttgctgatgccacctcatcaagaagcatgatggacaggatgtttgcacgcctcacgtctcgctcgaacggggatcatagtgaccacgagtgaggctgttctgcgttcagctggtagctgataaggacgcatcgcaaaattcaaggaaattcagaatctaattaaggacgagtgctccagagtcgggtctgctttccaaagtataggacatttgaagaactggtatgctactcactggtgaaggacagtcaggtgaaggactgtaagcccacacaagctcttcttatctctactagaattaaaatgttaagtcaaaaacggctccttttttgcgcctcctagtgaaacttaaccagctagaccatttgagtaccagcatttagttacaaacgtcaaaggcttccggtgctgcttaccttccttttttgttaatgtgcttttatttattaaaaaaaattacaatgaagatgcctgttttgtctctactgtgtactctgatcgtatctttccaaagtgcagactcttgtgaagttttcttaaattgttcactttaaagaaaatgacgtaccaacaatgatttggcttttatattactgtaagatgttataatgttaatgtggatgtagtgcttttactttacagattgattggaataagattattgcatatgaatttacccacaggactctgaatcatgttacccactcccctcacaatgttgtccacttagtgagttgcattgatctatccgtaccaaatgatgttgaataattacatatctttcttgactatactgatttcttattttggtcactattactaaatctctgttaatattctctcttttaactgaaaagggatgggatagaagggtttgcaatgccatattattggtggagggctgttttaacatctttgaagtatggcttgctgaatatctttaccaacatcttgaatatatattctagtgtccacaagatttagcaaaaagataaagcttgggtggaatatcattttaaaatgttcatgttctgttctatattttcttcacctactctccaaatattgtaatgcaaaaagtctcagtaatgatttggtagtattaattttgtggtcattgtttctcttcgataaatttattttcattaaatacttgttagagggttttgaaatgtttttcaaatatgtgaaatgtgaaactgctgtcttttatattaaagtaattaaagaaaatgtattgtgattgaaattattttggcctccacaagatggctctatgagtattcttccagggattctaatatttatttaaggtaataaaatcttgacatttataatctttc

SEQ ID NO: 92 - DNA, 3163 bp, Homo sapiens
cctttgccctgaagggggctggatgggcaaggcggccgcgatggctcgagctcgggcggtggcggcggtggccggaggcggcggtgcctcctcctcctcgccccggcgccggcggtgatccgagcgagcggccgcggcccccgatgagactgctggcgggctggctgtgcctgagcctggcgtccgtgtggctggcgcggaggatgtggacgctgcggagcccgctcacccgctccctgtacgtgaacatgactagcggcccgggtgggccggcggcggccgcgggcggcaggaaggagaaccaccagtggtatgtgtgcaacagagagaaattatgcgaatcactccaggctgtctttgttcagagttaccttgatcaaggaacacagatcttcttaaacaacagcattgagaaatcgggctggctatttatccaattatatcattcttttgtgtcatctgtttttagcctgtttatgtctagaacatctatcaatgggttgctaggaagaggctcaatgtttgtgttttcaccagatcagtttcagagactgcttaaaattaatccagactggaaaacccacagacttcttgatttaggtgctggagatggagaagtcacaaaaatcatgagccctcattttgaagaaatctatgccactgagctttctgaaactatgatatggcagcttcagaaaaagaaatacagagtccttggtataaatgaatggcagaatacggggttccagtatgatgtcatcagctgcctgaacttgctggaccgctgtgatcagcccctgactttgttaaaagatatcagaagtgtcttggagccaactagaggcagggtcatccttgcccttgtcctcccctttcatccctatgtggaaaacgtaggtggcaagtgggagaaaccatcagaaattttggaaatcaaaggacagaactgggaagaacaagtgaatagtctgcctgaagttttcagaaaagctggttttgttatcgaagctttcaccagactaccatacctgtgtgaaggcgacatgtataatgactactacgttctggatgacgctgtctttgttctcaaaccagtataaacacgtggaggtcgaagtcttcagagtccgcaccctccgggatgtgcccttggaagagggtctgtgttcacaattacgtgaagggaggacccttggggaccgccattctaaatatcatgtaggaatttaaaaagccaaaatactaattatttctttgtagtgtgtaaaggaatgtttttaaaagacaaaaacccaactctttgtggatttttatcaactctttactcagagccactctccaatgcaggtcacactccaattatgatggaagatattttttatacttaattgcagtagggactcattcccagacaaagcaatagtcacgacttcatggaaccaatcaatggattgttttttgaagactggcaataaagctgtccattcaattccaaatactggttttaaggtatagccactgatattctttcatgtttagaaattctttctgttattattcaagaaaatgtttttaatcatgctaataaacttttttggagatgactttggcatcatgtttgaattcatataaagctcccctagcattttttattggtttggcttcaggagtacccaaatagtagcattatgagaatgacgcagacaatttgaataggggggaaggaaggcttcagacttgggggaaggggagattattgcaaattgcagtgaacactgagtcagtaaaaaaaaaaaacagaaacaaaaacccagcctcattcagatacagaacttcagggacccctccccccacccccccagttaatgctgctgtgaaaaatgcaaaataacctggttctgactttgtgatcactcatgtcccatacactgaactttgtttttttctggacaatctcaggttctcagaattgaaacattcagttttgtctactgacaaaatgcaactaaaaatgttttaattcaacttcttactctacacttatatacctctctcccagagcttggctcttccctgaaatccttaaaggagtttattatttgccaagaatatggtttgatgaagaccgtgtcagactcatgcattctggaatccgtgagtgcctccaaccataaacccagaaatgctgccatagaggaacccattagcaagatcaataaccatcgtggatattccaaagagcagagcatttaacccagaatctgaaatctcagtaataacagaaatgtcaatatgagattgtggttattaacaatatgttatcctcactactttatttcttttttcatccaggtgtttcattaagtattctcatttatatgctcatagaagtcatcagatcaacacattcactccaacacctgggtataaaggcgaattaaaacctgaagaattactttattattcattaagaactgcattcccacatcctcacaccaatatcttccactgttactgtgcagtcataataagagttgggttatgtgatttatgcaaaattgttattggtgtgttctaatgatttttttccaggaattcaagtaagtgaagtacaaatacttagcaccatagattgtaaaaatagaaagaggaaatgagaaaacttaatgtcgttcttgtacagttgagttttgcttctttataaactgtctgttaaaatcaggggttgctgttagactgtcaagcagaagtgatggatgttcaaggaggcaggttgccccaaagtgttttctaactttcaagtagagaactttatgctctaataagaaaaatacaactcattcttaaccacccccccaaaacagagaaaacacatacatttatgcattttaaagataaaaagtagtttctcaaaaaaatctgaagttctctgaaaaccagcttattaaaagtgctgttttgtggtgaaaattgaaaccaaatccactcacatttcctatcgggtcttgaaattcttggtggtgtgtcaccattccactagatggcagtgttgcttactgagtgtcaatggcttttttccccgtaaatggaatcatgtttttctcccccaaagtacaataaagctgccttgtctgcaccaaaaacaaaaaaaaaaaaaaaaaaa

SEQ ID NO: 93 - DNA, 1250 bp, Homo sapiens
aattcggcacgagggcaggtgcaggcgcacgcggcgagagcgtatggagccgagccgttagcgcgcgccgtcggtgagtcagtccgtccgtccgtccgtccgtcggggcgccgcagctcccgccaggcccagcggccccggcccctcgtctccccgcacccggagccacccggtggagcgggccttgccgcggcagccatgtccatgggcctggagatcacgggcaccgcgctggccgtgctgggctggctgggcaccatcgtgtgctgcgcgttgcccatgtggcgcgtgtcggccttcatcggcagcaacatcatcacgtcgcagaacatctgggagggcctgtggatgaactgcgtggtgcagagcaccggccagatgcagtgcaaggtgtacgactcgctgctggcactgccacaggaccttcaggcggcccgcgccctcatcgtggtggccatcctgctggccgccttcgggctgctagtggcgctggtgggcgcccagtgcaccaactgcgtgcaggacgacacggccaaggccaagatcaccatcgtggcaggcgtgctgttccttctcgccgccctgctcaccctcgtgccggtgtcctggtcggccaacaccattatccgggacttctacaaccccgtggtgcccgaggcgcagaagcgcgagatgggcgcgggcctgtacgtgggctgggcggccgcggcgctgcagctgctggggggcgcgctgctctgctgctcgtgtcccccacgcgagaagaagtacacggccaccaaggtcgtctactccgcgccgcgctccaccggcccgggagccagcctgggcacaggctacgaccgcaaggactacgtctaagggacagacgcagggagaccccaccaccaccaccaccaccaacaccaccaccaccaccgcgagctggagcgcgcaccaggccatccagcgtgcagccttgcctcggaggccagcccacccccagaagccaggaagcccccgcgctggactggggcagcttccccagcagccacggctttgcgggccgggcagtcgacttcggggcccagggaccaacctgcatggactgtgaaacctcacccttctggagcacggggcctgggtgaccgccaatacttgaccaccccgtcgagccccatcgggccgctgcccccatgtcgcgctgggcagggaccggcagccctggaaggggcacttgatatttttcaataaaagcctctcgttttagc

SEQ ID NO: 94 - DNA, 1146 bp, Homo sapiens
ctttccttgcaccctcaccgcatatggaactcctggcgtcgtgtcccaggtcacgcctgtccccgtggggaggctgggcccctccccccagccactcccgagacttgagacctctgcctcaggacgatgggtgggaaggggcttgcggcgtttgcctcagcatggagggcggggccgcggcagccacccccacagcactgccttactacgtggccttctcccagctgctgggcctgaccttggtggccatgaccggcgcgtggctcgggctgtaccgaggcggcattgcctgggagagcgacctgcagttcaacgcgcaccccctctgcatggtcataggcctgatcttcctgcagggaaatgccctgctggtttaccgtgtcttcaggaacgaagctaaacgcaccaccaaggtcctgcacgggctgctgcacatctttgcgctcgtcatcgccctggttggcttggtggcggtgttcgactaccacaggaagaagggctacgctgacctgtacagcctacacagctggtgcgggatccttgtctttgtcctgtactttgtgcagtggctggtgggcttcagcttcttcctgttccccggagcttcattctccctgcggagccgctaccgcccacagcacatcttctttggtgctaccatcttcctcctttccgtgggcaccgccctgctgggcctgaaggaggcactgctgttcaacctcgggggcaagtatagcgcatttgagcccgagggtgtcctggccaacgtgctgggcctgctgctggcctgcttcggtggggcggtgctctacatcttgacccgggccgactggaagcggccttcccaggcggaagagcaggccctctccatggacttcaagacgctgacggagggagatagccccggctcccagtgatgcgcccggccggccctgggggttcgcggggtgtcttcttgcctgcccctgctgaggcgtcttcaggactgcaggctccggagagtggctctggcagcaggcgggcgcgtgggtgcagctgcatctgtttgagtgctgctttctggggtcaggtctccgcctcctctgcttctcctttctccgctgctatagaccagttcattgtgtgtgaaaaaaaaaaaaaaaaaaa

SEQ ID NO: 95 - DNA, 543 bp, Homo sapiens
  misc_feature (330)..(330): n is a, c, g, or t
ttttacaaattatatacatttatttttaataattttaaataacactcttgtataaattctttcatatattcaaatcatacacaaatttagaaatgcatgatgaagcctagtacagcatatgtatgagacacattttttaagtttgtgttagaattttagtgacataaatacaagtttaatgtttcagaaacattccctaattgctcggcctataatttaatgtattatagagtgcttatgcctagcattacaacttgactttaaatcatttagcttttggactaacttagatctgaagccctgggttactttctagggctgctgctgcanaacaagtaacaattcctacccacatagcccaaaatataggaaccagggatgttcattataagtggtgttatgttcaccaagcatcctaaaaagtgtaggaccaaggtgaatgatctaataaccccattccaatcaaagctgtcaagaggaagtattgttgctttagttttctactcccaaaacagccttaaaggggtaaatatccctcgtgcc

SEQ ID NO: 96 - DNA, 392 bp, Homo sapiens
ttttttttttttttttttttttttttttttttaggaaaacaaaatatttttattagcccttaacagaagaaaaacccaaatggcaaataaatacatgaaaatgaacatactgtccaccagattggctaattggagaaggtatgcataaatgagctcccatatattgctggtaaaaaccactatggaaaactttggcattagttagtgcaactgacaatatacatattcctatatccagccattctaaatcttaaacataaatagacaagttgacagcagtatattcataaaaagaaatacaaggggaaaagatacctttatatggaaaaaacattggtaaaaacattaaagaatcagacaaaaggatatgtaacatacgtttctgtttatag

SEQ ID NO: 97 - DNA, 962 bp, Homo sapiens
agatgggctatgtgaatatgtttttaaacatctgatatgtgcatgaaacaaaaaacacttgaagttattatgtatacaattctgtgggatgggacttcattcaggattggttttcaagtttgatttcctgagggattttttagttgtttgtgaaagaaccccaggtctacttttgaaattttgtattataattgtaatgttgcccatggttaaaaaaaaaaagtgttcagtgatctatgtctcctactactcctatttctctgtttttcctctgcaggagcttgctgctgttaacagttattcttccaagttgtttctttgtggggagatgggaggtgggaggaaatataaacatatatgtatagatctttcaaaatatatgacggtatacccgtatgttctgagtcttgctgtattattacctggtaatatttagaaacatttattttgagataaaggcagagcacttttaagttgaacctgtagttttaaaacagtacatttcaagtaagccaaagcagagaagtaaatgtatttttcattgttgtatcagaattttgaatttactattttaacaaattcaagagtttgtagctgatctatttcttcccctcaggcataccaaataggtcatttgtcaaccgatttaagaaatgtttagaaaacgaacactttggggaaagcggggaaccaattgatattaagtgggatgtgccataactactttagttgacattcattaccctggatgatacgtgaaggaaattttaacatgcgtaccaggattggttaagcttgtgtgtcatcgacgaacaaaaaaagccgggagtccagggtcaccaagtctttgcaatctgggtcatccaaaggtatctcaaagaatgagcgttttgttggacatccataggcaacaaggcacaatctgtcaagagacgagaacgaaaacaaaattcaagggacgg

SEQ ID NO: 98 - DNA, 528 bp, Homo sapiens
ttttttttactttgagaagccatttattttgcagccttcagtccaaaaaaagtcaacattttcagaatttttttatataagttgtaggtcatttttataacaataaactttctattatctatttatctctcacatacatttcatgtatcctgagtattatgttacaacaatctgctcttgatagtaatgttcctgatagattaaaagattgagaaatacttgaagaacgatcaaagatacaatgagcatggtatacttttgggttaaaatgtattctttgataactgatgtcatatagatccctaagtaaatcaaatatttaatttcctacatctgtctaccttagttaactggcccattcctataagcttaacaaaaactcactttacaattatttaaaaaaaacatttaagagatttttagaagttaaatggaaagatacttttggacattacaatatttttaatgagttattattttaaaattagagatttcacataaaaaccaggattctttgttttctcttta

SEQ ID NO: 99 - DNA, 455 bp, Homo sapiens
tttttttttgggtaagacacaatttatgggaaaatttaaaacccacaacactatgtatttctatatgtaaacatatagatatattaatacatagcaaaaagatatttgaggaatatatactagagaccaatagttactaccatttgggagcactaccaaagggcactttgacaatatatgttttttattcttttcctagaacattttcttacataattaaatacaaaatgaggaactttcatatttctaggaagtaccacatacaatgatttccttaaaatagcttgctactaaagctagagtttagcagataccacttctttctacttttcaacattatactttatccttgctatccctcaccaattctctcattgatctacacatgttcaaatgtaaagaaatcaccttagctttttcttaaaatacgtgatagtgaagagatgatacagttg

SEQ ID NO: 100 - DNA, 605 bp, Homo sapiens
  misc_feature (229)..(229): n is a, c, g, or t
tgaaacaaacgccgggtttaatgtagggcacaggcaccccggagaagtcagctccgtgggaaccgtgggctcagagcacccaggtcatggtggggcagggccaggcctcacctggggaggcccagaaagggagggccacactcaaggtccagggcaagtccacgtgcagacggagccctgcagcccacactgctgttgccaggtgtggctgcgcgggacactcctcggngacaagggcagcagtccagagcacaggaaggaaatgtagcttctcagtgctggggtgcaaggctgaggggccgatgggggacaatggccaccaccaggaggcagcccgggctcacagaccatcttttgccagcctgtacacccgcttcaccctggcatagggccccagggagtcctcaaacacaaaatcccagagcaccttcacccaggagtggtgctgcggcaggtggtcgtagtactcgggcgcgatcttccgcaccagcgggaggttgtagccccggatgctggggaagtcgtggtgctcacgtgtagcccacattgaagggatcagttggaggcccatagtaggagtggtctgtggccctgaggaacatgta

SEQ ID NO: 101 - DNA, 950 bp, Homo sapiens
tggagccggagctgaagccggagccgggttggagtctgggcgggggccgggccggagcgggctccagagacatggggtcgaccgactccaagctgaacttccggaaggcggtgatccagctcaccaccaagacgcagcccgtggaagccaccgatgatgccttttgggaccagttctgggcagacacagccacctcggtgcaggatgtgtttgcactggtgccggcagcagagatccgggccgtgcgggaagagtcaccctccaacttggccaccctgtgctacaaggccgttgagaagctggtgcagggagctgagagtggctgccactcggagaaggagaagcagatcgtcctgaactgcagccggctgctcacccgcgtgctgccctacatctttgaggaccccgactggaggggcttcttctggtccacagtgcccggggcagggcgaggagggcagggagaagaggatgatgagcatgccaggcccctggccgagtccctgctcctggccattgctgacctgctcttctgcccggacttcacggttcagagccaccggagagcactgtggactcggcagaggacgtccactccctggacagctgtgaatacatctgggaggctggtgtgggcttcgctcactccccccagcctaactacatccacgatatgaaccggatggagctgctgaaactgctgctgacatgcttctccgaggccatgtacctgcccccagctccggaaagtggcagcaccaacccatgggttcagttcttttgttccacggagaacagacatgccctgcccctcttcacctccctcctcaacaccgtgtgtgcctatgaccctgtgggctacgggatcccctacaaccacctgctcttctctgactacmgggaaccctggttggaggaggctgccaaggtgctcattgttactttggaca

SEQ ID NO: 102 - DNA, 961 bp, Homo sapiens
gaaaattgtatggagaacttaaaacatcacgaatatttttaataggatccgcagacacccaaaggagaagcttggtcttttccaggtatttccaacttgagttcaacccaaagcctttgaaaggaatgcattaccacatgaccacatgctgagaccccatggggtctaacacgggacctaagaaagtctctgcagccagatagtacatggtgtctccacaaaactaggcattctggagattgcccagaaagggatgtgaggggaccgttaagatctgtcttgcttatctcatgcactcacattccttcagcctcctggagttcctgataaaaggaagccaggtgtggacattttttagctattgatttcccaatagcttgtggatcagttgtacacccacacttccttctctgcctaattccgtttttctggaaaaagtagtatgcccatgtatgtgtgtttttcttaacacaggtccatgaaagttggcttcctggttgatgtctgttgcgtggcctggaaaccagggagcagcaactattgagatggtttctgtgttcagtgaaaaattctatttcattgagacatttttctttatccacagtaattttttgacactgtcatcatgaaactaccccttaggaaaataagattacctggcaaaaataagagaaacggaaactgacgttatgggacattaggaaaccggtttgtgaaggattctggaattaaacttagagctgcattacctttacgatgggcaacacccttgagtttgatttccaaggttagttaaaggcctagttatatttatcaagtctaggcactatttattactccccagcggtgttgtatcaaaggggggggaggaaggataaactggggaaaggctgtgaaaccctgttctacaaaaggaggatcttgtgaaagagatttcggcaatattgattggtgggagaga

SEQ ID NO: 103 - DNA, 405 bp, Homo sapiens
gtcttctaagtcttcatgtctacagtgttattttttgctattattttttgtttcttcgacagtgacataaactgaggtaaacatctgtgaccaacacctctcctaaggggcaaagggtcccagcccgaccagcagaggaggtggcagcaccagggccccaacctggtgttccggttctgctctggggtcaggctggaggctggccctctgggtgcctctgggaatgagggggctgggctacataactatggtcccctcccaactctaacatactagatactacaacggctggggaaactcccgaacaggatcttaacagagagagggagagagagaaagagaggagagagagagagagagagagagagagagagagagagagagagagagggagagagagagcgc

SEQ ID NO: 104 - DNA, 2051 bp, Homo sapiens
acatgacgaagcaacatgaattagggggcctcttggccttggtccaaaattgtcaatcagagatgaacataaaggactccagagcagtgggactgtctgtcaaaagactctgtatatcttttgtggatgagttttgtgagagaacagagagaccattgtacctggcacaagggctcttcatgaaaagggagacttactgggaggtgcaagacagtggcatttctcctctcctcttgctgctcagcacagccctggattgcagccccgaggctgagaccagacaaagcccgggaggcagaaagatgctccaagaaccaacactatcaatgtctttgcaaatcctcacaggattcctgtgggtccagctttggaactgggaaacctttcttcggatccgcactcattccactgatgccagctgcccctgaaggatgccagtactgtggtgtgtgagtctcagcagccgcccacacgctcctaactctgctgcatggcagatgcctaggtggaaatagcaaaaacaaggcccaggctggggccagggccagaggggaaggccctggattctcactcatgtgagatcttgaatctctttctttgttctgtttgtttagttagtatcatctggtaaaatagttaaaaaacaacaaaaaactctgtatctgtttctagcatgtgctgcattgactctattaatcacatttcaaattcaccctacattcctctcctcttcactagcctctctgaaggtgtcctggccagccctggagaagcactggtgtctgcagcacccctcagttcctgtgcctcagcccacaggccactgtgataatggtctgtttagcacttctgtatttattgtaagaatgattataatgaagatacacactataactacaagaaattataaatgtttttcacatcaggctgttctttttttttttttggaggcgaggttaaagcattactatttgcaaagcactctgtagctccctgttatggggataggtaactaatcagaataataatgtcactcgcatccacttcttagaacctggctccaaaggaaaataagctgatagactcaatcactttcctgaggatggaggcctatggcatgtgtggctgcaggtcgcgaagctgcttaatggtgctgggaagcctagaggaattaaataaagaccctggaggaggtgggatcggagctgcaccttgaacaaatagctcagatttgaacagatggatggaaaagagggaggtgttcccaaccaaggggacatgatacagggaacaggtcctatgtctctttactcctgagagtattaaacctagtaggtgggcagcccctcttggttgcctgttaccttattttgaattctttttgcaaaacatactatcacccgtccaaataatcttttgtctaaatccagacttcacattctgactggggcaaaaagaggcagtccagtaaaggttataaaataggtaccatcattgtttgccttatttagaaaagcttccaattttcactataatcaccctaagcctgagagaggtgaactgttcaagggtactttggctccagtgggtgacagtacctggcccagctttggaattgaaacatttctgatggtctgtactctgctagaacacaggatgcttctgctctccctgctctggcatcctgccaggtgtcatggccacgcacaggcatgaagacagccgggaagccagagttcccacgaagcactcactccttggacttgctcccaccccactggggagagcactcctggagcaggaaatgagcatctctcatctccctgaattccacatccactggctgaatgatcagggaggcatagcagtgagagccataggtcggcagagggaactcaggccctcctttaggatggccatcacctcatctcaatccagccaaatcaaccatctagagcacacaggccgagagaaatgtaataaaatataacatgagacacgtatgaaatttaaactttccggtagccacactagaaaaaaaaaaaaaaaaa

SEQ ID NO: 105 - DNA, 1291 bp, Homo sapiens
gtgagcgcatgtgcgcatttatgagcatctacttgcggctgcactcagggccatttgaacccagtgcagagttatctctatgaggaggccccgggtctccagccccctccatctcccctggggtttggcatatttgacatggagccccatgccaagggatgcagctgttggtgtctgtccagtccattcaaggctagcctgcccatgcactgtggcaggggttggattggagggagagaacagagttgggaaaaacaacaggtttgagtcctataaagccataatttaactccagtagctgatgtcagacaagcttgtcctatgtcctatttgagtggcagcagcgccagcccagcaagaaggctgggggttgtcaaggttgtccccagaccttgcttgcagtggttggagaacccagggggctgccttgggccctctggccagagggaagcgggcagctctagccctggagattgtggtcacattggggcttgtttaggattggagggccaggtcacctccccagccaccctcccttctctcctctggggtccccactttagggcgactttgcccgaggcccacgcatccatccactcctttagtgccttgaatctcattcacaagcagccccctcccttccccttcccttctcactctgttgatgtaatcctcccacccccagtgtccatcctaagacaggcatcaaaagaggccctaactttacttcccaaatggtgctttttaaaaaacaccatcactacattaggggcaattttttcacacctccctgtcttcagaatgtaaagggtggggattatgtctctgtttaatatgcagccccctgcactgtggggtttggggcatgttcagtaataagaatgaatacaatagacaaagggggtgtgatgagtgttaacttggttgttccagaggtaaaccaggtctcagggaagagcctggagctgctattgcttaggaagttgtacgtgccttgaaatgtccactacctgaggacgcagcatctggtgggcccggggctgctggggccaaggagggaccttgaccttctggtgcctgcccctccccggcctacgtgccatccgcgtgacgctaggtcagcgctgccggttctttaccaaatgtgcttgcttctcctaagttatttataaagagaaatcactaatggactctactggtttgagtgcttctgagctggatgaccgaccgcctgtatgtttgtgtaattaattgccataataaactttgatgagtcaaaaaaaaaaaaaaa

SEQ ID NO: 106 - DNA, 641 bp, Homo sapiens
ttgggagtagtgtctttattcattaaagcctgaggtctgaccacccctgtaaaacctcgtgcccacacagtgcctgtctgagtccttctgtgcccaaatgtggagcaggctgcagagacttgaagcctggggttttgtgcctcctttttgttttgttttttttgagacagagtcttgctctgttgcctaggctggagtgtagtggtgtgatctcggctcattgcaacctctgcctccagggttcaagtgattctcctgcctcagcctccagagtagctgggattacaggtgtgcaccaccacgccaggctaatttttgtatttttagtagagacagggtttcaccatgttggccaggctggtctccaactcctggcctcaagtcatcctcccgccttagcctcccaaagtgctggaattacaggcatgagccaccacgcccgggcatcttcttgccagcaactcttagaccaggaagcctcggatggcagctatgaagtcctgtgggcgttcagcgtggatccagtggccagcgttcagcaccgtctgcatctggacaggatggaagagccgcataatcttcaggtgatagctggaatgcacgaacttggagattccaccaaggagaaagagtgtgagacc

SEQ ID NO: 107 - DNA, 1433 bp, Homo sapiens
attcggggcgagggaggaggaagaagcggaggaggcggctcccgctcgcagggccgtgcacctgcccgcccgcccgctcgctcgctcgcccgccgcgccgcgctgccgaccgccagcatgctgccgagagtgggctgccccgcgctgccgctgccgccgccgccgctgctgccgctgctgccgctgctgctgctgctactgggcgcgagtggcggcggcggcggggcgcgcgcggaggtgctgttccgctgcccgccctgcacacccgagcgcctggccgcctgcgggcccccgccggttgcgccgcccgccgcggtggccgcagtggccggaggcgcccgcatgccatgcgcggagctcgtccgggagccgggctgcggctgctgctcggtgtgcgcccggctggagggcgaggcgtgcggcgtctacaccccgcgctgcggccaggggctgcgctgctatccccacccgggctccgagctgcccctgcaggcgctggtcatgggcgagggcacttgtgagaagcgccgggacgccgagtatggcgccagcccggagcaggttgcagacaatggcgatgaccactcagaaggaggcctggtggagaaccacgtggacagcaccatgaacatgttgggcgggggaggcagtgctggccggaagcccctcaagtcgggtatgaaggagctggccgtgttccgggagaaggtcactgagcagcaccggcagatgggcaagggtggcaagcatcaccttggcctggaggagcccaagaagctgcgaccaccccctgccaggactccctgccaacaggaactggaccaggtcctggagcggatctccaccatgcgccttccggatgagcggggccctctggagcacctctactccctgcacatccccaactgtgacaagcatggcctgtacaacctcaaacagtgcaagatgtctctgaacgggcagcgtggggagtgctggtgtgtgaaccccaacaccgggaagctgatccagggagcccccaccatccggggggaccccgagtgtcatctcttctacaatgagcagcaggaggcttgcggggtgcacacccagcggatgcagtagaccgcagccagccggtgcctggcgcccctgccccccgcccctctccaaacaccggcagaaaacggagagtgcttgggtggtgggtgctggaggattttccagttctgacacacgtatttatatttggaaagagaccagcaccgagctcggcacctccccggcctctctcttcccagctgcagatgccacacctgctccttcttgctttccccgggggaggaagggggttgtggtcggggagctggggtacaggtttggggagggggaagagaaatttttatttttgaacccctgtgtcccttttgcataagattaaaggaaggaaaagt

SEQ ID NO: 108 - DNA, 1825 bp, Homo sapiens
aagagccctgacttcccttgttttccccccttgcgcccaacgtgcgtccgctcccccgccgagcgcggagtcgcctcagttgcccaggcctctatctgcatggagggccgggccgccgtgaccagatctgcgcacggggtacggacgtgcccgggcagatgggggcctacggggtgacaccgaggccgggacagcttcaggggccccagaaggacctgacccagaaattgaggtccccgctgccttctgaggagggggaggagttgctcctaggtctgaaccccgccagccttgccccgtaggaagctggagtgcgggcctcgtccacccacagaccccggggagcgcagggaaaagggtgcttcggtcgttccgatggcagtggagaccacggtccacactcacctctctgcgtctccaccgcagggctctccctacgaccacacacccggcatggcgggctccttggggtaccatccttacgcggcgcccctgggatcgtacccttacggggacccagcgtaccggaagaacgccacaagggacgccacggctaccctcaaggcctggctcaacgagcaccgcaagaacccctaccccaccaagggcgagaagatcatgctggccatcatcaccaagatgaccctcacccaggtgtccacctggttcgccaacgcgcgccggcgcctcaagaaagagaataaaatgacgtggacgccgcggaaccgcagcgaggacgaggaagaggaggagaacattgacctggagaagaacgacgaggacgagccccagaagcccgaggacaagggcgaccccgagggccccgaagcaggaggagctgagcagaaggcggcttcgggctgcgaacggcttcagggaccacccacccctgcaggcaaggagacggagggcagcctcagcgactcggattttaaggagccgccctcggagggccgcctcgacgcgctgcagggccccccccgcaccggcgggccctccccggctgggccagcggcggcgcggctggcggaggacccggcccctcactaccccgccggagcgccggcgcccggcccgcatccagccgcgggcgaggtgcctccgggtcccggcgggccctcggttatccattcgccgcctccgccgccgcctcctgcggtgctcgccaagcccaaactgtggtctttggcagagatcgccacattgtcggacaaggtcaaggacgggggcggcgggaacgagggctctccatgcccaccgtgtcccgggcccatagccgggcaagccctaggaggcagccgggcgtcgccggccccggcgccgtcacgctcgccctcggcgcagtgtccttttccaggcgggacggtgctgtcccggcctctctactacaccgcgcccttctatcccggctacacgaactatggctccttcggacaccttcatggccacccggggcccgggccaggccccacaaccggtccggggtctcatttcaatggattaaaccagaccgtgttgaaccgagcggacgctttggctaaagacccgaaaatgttgcggagccagtctcagctagacctgtgcaaagactctccctatgaattgaagaaaggtatgtccgacatttaacgcgggctgcgtcggtcccggacttttctaatttattaaaaacatggccttggcagttatttttccatcaccgagagagagagacagagagagaaaataaactacccctcctattcagaagtttatagtttatggagatggatgacataaaaatgtaaacatctccacacacacaaaaaaatgttttaaccaaccg

SEQ ID NO: 109 - DNA, 1427 bp, Homo sapiens
attaacccaggagatgggggtcgaggagagaccccggggagtagagagagagaaactcactccccgagtccccgaccctccccaagcaaggttataatataacttatcctctcatgcttttttcctgccccttctccccaaatcatcaacaatagaagaagaagaaaacatgtcaggacacaaatgcagttatccctgggacttacaggatcgatatgctcaagataagtcagttgtaaataagatgcaacagaaatattgggagacgaagcaggcctttattaaagccacagggaagaaggaagatgaacatgttgttgcctctgacgcggacctggatgccaagctagagctgtttcattcaattcagagaacctgtctggacttatcgaaagcaattgtactctatcaaaagaggatatgtttcttgtctcaagaagaaaacgaactgggaaaatttcttcgatcccaaggtttccaagataaaaccagagcaggaaagatgatgcaagcgacaggaaaggccctctgcttttcttcccagcaaaggttggccttacgaaatcctttgtgtcgatttcaccaagaagtggagacttttcggcatcgggccatctcagatacttggctgacggtgaaccgcatggaacagtgcaggacggaatatagaggagcactattatggatgaaggacgtgtctcaggagcttgatccagacctctacaagcaaatggagaagttcaggaaggtacaaacacaagtgcgccttgcaaaaaaaaactttgacaaattgaagatggatgtttgtcaaaaagtggatcttcttggagcgagcagatgcaatctcttgtctcacatgctagcaacataccagcttgcctgggaccagtggcagggaccccggaacctgaaggtgctgacaaagatgacctgctgctgttgagtgagatcttcaatgcttcctccttggaagagggcgagttcagcaaagagtgggccgctgtgtttggagacggccaagtgaaggagccagtgcccactatggccctgggagagccagaccccaaggcccagacaggctcaggtttccttccttcgcagcttttagaccaaaatatgaaagacttacaggcctcgctacaagaacctgctaaggctgcctcagacctgactgcctggttcagcctcttcgctgacctcgacccactctcaaatcctgatgctgttgggaaaaccgataaagaacacgaattgctcaatgcatgaatctgtacccttcgggagggcactcacatgccgcccccagcagctcccctgggggctagcagaagtataaagtgatcagtatgctgttttaataattatgtgccattttaataaaatgaaagggtcaacggccctgtttatattggtataaaaaaaaaaaa

SEQ ID NO: 110 - DNA, 823 bp, Homo sapiens
aaacgtttatttctcactcaaaacttatttcccctcaaccctatacccaaagaagaaataaaatcacagaaacataacagaagtatttgaggtaccctctcatatatgcaaacaaatgcagactaggcctcaggcagagactaaaggacatctcttggggtgtcctgaagtgatttggacccctgagggcagacacctaagtaggaatcccagtgggaagcaaagccataaggaagcccaggattccttgtgatcaggaagtgggccaggaaggtctgtaccagctcacatctcaactgcatgcagcacggaccggatgcgcccactgggtcttggcttccctcccatcttctcaagcagtgtccttgttgagccatttgcatccttggctccaggtggctccctcagtctggactctaccacttgggtctccagattttctgttacgtccttgtgggtcaggatatttctggaagtcactccgtgaggctggtaatcctcagamccagcttctggtcgactctggaatggactgaagctgggcaggatgatgagagccagggaaaaaagaagaatcaaaacacaagtgctggtctgggcagctttgttggaagtttgagcaattagcgtctgcagctggcggastgagctaccaaggagatgttgtgcctctccagctcctggacttttttctgtaattcttggttctgtrcagaacaggctgccaccctgctctccagcccatcaatgtactccttcttccgccgccgactgtmctgagctgactgcttgtaacggattttcctcctgaccttcttgagga

SEQ ID NO: 111 - DNA, 553 bp, Homo sapiens
  misc_feature (498)..(498): n is a, c, g, or t
agggggttaaatgtttattaaatcaagcttttaaattatatatccacctacagtctataaacaaatatagtacacatgtatgtaaaaggctagcagataagaaccagtggaaaaactaaagttccctttgcacaccggcacctcatcacaacaccctcttggtgtggatgccatggggccatgctgtagtcaaaagttaaatgaaaaaccacaagtttagtttgactccgtctcctagggtggatttcattcagatatttgttccatattataggagggtggatcctagcaaggcaacagtgtagtttttacattcacagattggctgaagtagtacaaattgagctgctaatctaggtgtctccctccctgttaccatacttcataagaaatgtgaattaaaatgaacaatggaccacaggtggttataaaaatagataactcgcagagtccataaatatctacagttagtagagccagaacttccaaaatttaccntttttccataatggtgcagaatatccccaagtatggttccaagaggacacagtca

SEQ ID NO: 112 - DNA, 425 bp, Homo sapiens
  misc_feature (388)..(388): n is a, c, g, or t
  misc_feature (417)..(417): n is a, c, g, or t
gcggccgccagcccagggcctgcccatccagaagggactccccagggcctgggggaggagacccttggaaaagtcctctcttcccagctcctgattctggatctgagattctcagatcacaggcccctgtgctccaggccgaggctgggctaccctcagggagatccagagactcatgcccatggccatccatgcgtggacgctgtgtggagagtccaggatgacgggatcccgcacaagctcccttcagtccttcagggctgggcccatgtggttgatttttctaaagctggagaaaggaagaaattgtgccttgcatattacttgagcttaaactgacaacctgggatgtaaataggagccttttaactggtttattaataaagtnctattggtgattttttaaaaaaaaaaacnctcgtgcc

SEQ ID NO: 113 - DNA, 544 bp, Homo sapiens
tttttttttttttttttacaacaatgagaatctttatgcatatagctttgtgatcaatacaatccttcagaacaacaagagacaaacaaaggaatacaatgtcccaaacagctgcagtccacaggctgacattgctaactagatttagatcatctggaggcttttgtaagaggaactgaggtgcagaggcatcagaatgagttgattcccggcaaaagggctaagaggctacagacatatctaaaaatcaagaaaccactacttgttaagtacttctggtgtttgcatacagtgtccaatacatagggaagatagcaagtccatactggtctttgtacatgctgtgtggtagaggctactgcaggtttctttattttctaaagtaggcaaggctcataaattgaccaattcacattgtgattacttggtacaatgcatgcatgttattggtacacagagtgctttaataggaatctgttggattttcaaaattctgacaaggccatttttacctcagaggactattatcctttccctcgtgccg

SEQ ID NO: 114 - DNA, 507 bp, Homo sapiens
tttgtttaaaaatgtgttttaattatattttcatgaattccaggaagaacatcattgcagttaatgttacaaaaaaaaaaaaacaaagagggacatctgaacatgcaataaaaaagtgaattcacagtgaaaataatgcatgtcagtactaaaatagagttgcttggttccctgaaggaaaagggtttcttctaattatctgttcacttggattttattatgagaaaatattctgtgaaagctttggggaagttttcaatttgtgctactattatcattagagtctgatggaagtccctcattctgaaagccgttgttcgcagtctgtaattcaatcagaaaattcaaaagtacaacaggtagtttggcaactcgcttcttgttacatacaaagccattagcaaaaatatgtaacaaaatttatgtaaaacaaacaattttgtccttatgtacaaaagacagccttcttcctcacaccctcacggcctattccaaaaagtgggaagg

SEQ ID NO: 115 - DNA, 4790 bp, Homo sapiens
gaaagagacattcacttggagggctcttgctgaaaatgggtttaactctccttttgccagtcaccaccagcctgacctcatacacttttagtacaatggagtggctgagcctttgagcacaccaccattacatcatcgtggcaaattaaagaaggaggtgggaaaagaggacttattgttgtcatggcccatgagatgattggaactcaaattgttactgagaggttggtggctctgctggaaagtggaacggaaaaagtgctgctaattgatagccggccatttgtggaatacaatacatcccacattttggaagccattaatatcaactgctccaagcttatgaagcgaaggttgcaacaggacaaagtgttaattacagagctcatccagcattcagcgaaacataaggttgacattgattgcagtcagaaggttgtagtttacgatcaaagctcccaagatgttgcctctctctcttcagactgttttctcactgtacttctgggtaaactggagaagagcttcaactctgttcacctgcttgcaggtgggtttgctgagttctctcgttgtttccctggcctctgtgaaggaaaatccactctagtccctacctgcatttctcagccttgcttacctgttgccaacattgggccaacccgaattcttcccaatctttatcttggctgccagcgagatgtcctcaacaaggagctgatgcagcagaatgggattggttatgtgttaaatgccagcaatacctgtccaaagcctgactttatccccgagtctcatttcctgcgtgtgcctgtgaatgacagcttttgtgagaaaattttgccgtggttggacaaatcagtagatttcattgagaaagcaaaagcctccaatggatgtgttctagtgcactgtttagctgggatctcccgctccgccaccatcgctatcgcctacatcatgaagaggatggacatgtctttagatgaagcttacagatttgtgaaagaaaaaagacctactatatctccaaacttcaattttctgggccaactcctggactatgagaagaagattaagaaccagactggagcatcagggccaaagagcaaactcaagctgctgcacctggagaagccaaatgaacctgtccctgctgtctcagagggtggacagaaaagcgagacgcccctcagtccaccctgtgccgactctgctacctcagaggcagcaggacaaaggcccgtgcatcccgccagcgtgcccagcgtgcccagcgtgcagccgtcgctgttagaggacagcccgctggtacaggcgctcagtgggctgcacctgtccgcagacaggctggaagacagcaataagctcaagcgttccttctctctggatatcaaatcagtttcatattcagccagcatggcagcatccttacatggcttctcctcatcagaagatgctttggaatactacaaaccttccactactctggatgggaccaacaagctatgccagttctcccctgttcaggaactatcggagcagactcccgaaaccagtcctgataaggaggaagccagcatccccaagaagctgcagaccgccaggccttcagacagccagagcaagcgattgcattcggtcagaaccagcagcagtggcaccgcccagaggtcccttttatctccactgcatcgaagtgggagcgtggaggacaattaccacaccagcttccttttcggcctttccaccagccagcagcacctcacgaagtctgctggcctgggccttaagggctggcactcggatatcttggccccccagacctctaccccttccctgaccagcagctggtattttgccacagagtcctcacacttctactctgcctcagccatctacggaggcagtgccagttactctgcctacagctgcagccagctgcccacttgcggagaccaagtctattctgtgcgcaggcggcagaagccaagtgacagagctgactcgcggcggagctggcatgaagagagcccctttgaaaagcagtttaaacgcagaagctgccaaatggaatttggagagagcatcatgtcagagaacaggtcacgggaagagctggggaaagtgggcagtcagtctagcttttcgggcagcatggaaatcattgaggtctcctgagaagaaagacacttgtgacttctatagacaatttttttttcttgttcacaaaaaaattccctgtaaatctgaaatatatatatgtacatacatatatatttttggaaaatggagctatggtgtaaaagcaacaggtggatcaacccagttgttactctcttaacatctgcatttgagagatcagctaatacttctctcaacaaaaatggaagggcagatgctaggatcccccctagacggaggaaaaccattttattcagtgaattacacatcctcttgttcttaaaaaagcaagtgtctttggtgttggaggacaaaatcccctaccattttcacgttgtgctactaagagatctcaaatattagtctttgtccggacccttccatagtacaccttagcgctgagactgagccagcttgggggtcaggtaggtagaccctgttagggacagagcctagtggtaaatccaagagaaatgatcctatccaaagctgattcacaaacccacgctcacctgacagccgagggacacgagcatcactctgctggacggaccattaggggccttgccaaggtctaccttagagcaaacccagtacctcagacaggaaagtcggggctttgaccactaccatatctggtagcccattttctaggcattgtgaataggtaggtagctagtcacacttttcagaccaattcaaactgtctatgcacaaaattcccgtgggcctagatggagataatttttttttcttctcagctttatgaagagaagggaaactgtctaggattcagctgaaccaccaggaacctggcaacatcacgatttaagctaaggttgggaggctaacgagtctacctccctctttgtaaatcaaagaattgtttaaaatgggattgtcaatcctttaaataaagatgaacttggtttcaagccaaatgtgaatttatttgggttggtagcagagcagcagcaccttcaaattctcagccaaagcagatgtttttgccctttctgcttcactgcatggatacagttggtaaaatgtaataatatggcagaattttataggaaacttcctagggaggtaaattatgggaagattaagaaaggtacaaattgctgaggagaagcaggaaacctgtttccttagtggcttttatcccctcggcatgcgatggggctgatgtttctataattgcctcagactttcacatttactagtagggctgagagaggctttagtgaggaaggaatattcagaataaaacggttgagaaagctgagaagaccattgagttttgatcagttgtgaatagagtgcaaagccatggccaagctgtttttggaaacgctggccggcgtgtcttcagtggaaaaagcaaatcaaaatggagcgagagcaaaggggcgtcctcagtcctcaacctacaatcactgtatggaatcggtcctggcagctgaacataggaggtcactggaacaagtgatagtgcagattggctttcaaacatcctcctggcttgagttttatcagctacagtgtgggtcctcttttgaagccttaattcacaacagcagctttttgggggtggggctgggcgggtgttgtcattgttctttcccttcctgtaagtgtcgctagttgctgcctcgtatctcaggtttttctctgtttttgagaaatggacagttttttgaccaggatgtgacttcatgtttcctatggtgacttctaaaaccagcacagaatgatatgactcaacacagaccgacttggttatggggatgatgagccgcacagacctcactagttgtgcacaaataatgtgctatgatggggtgtaaagtgaaggcagaagagggtcagccgcattgttatgatactgggaaagtgctggtcaacgatttgagttagtttttagatatacattgaaatctttaatcagacattctcaagtttcacacagtagtttttgatgttatgtacacacacaccaaatgtgtaacagttcaccacttccagagtgtggtcatgcccaaaacatgtttaagaaaggaaagcagtagctccttgctaacgatgtttcaggaggtttgggggacttggttttaatgagcttctgtcatttagggcttctcttggccatggtccccttccttctggaactgtgatgtagtcacatcctacagcctttagtgctggttcactagtgtcagataatcagttcttggaatcgagactgccgtggcgaaggggtggcctcggaggcaggctctggagctgcttggatgtctttaggtggggtggtggctggctctcttcagcatgtaattggggaaaccctcgtttctactaggggtgatacagatggtgattttaaagagcaaaactagacttctatgtgagaagtgctggaaaatgatttaggacatgtgtaaagttagatggaaagactgtaaatgtttaatatgaatatagtgttcttttgaagtaaggccagctgttgaacggttaaactgtgcatttctcattttgatgtgtcatgtatgttaatgtatgaaatgattaaataaaatcaaaactggtacctgtttatacat

SEQ ID NO: 116 - DNA, 2016 bp, Homo sapiens
aggacctgagctcagcttccgccccagccagggaagcggcaggggaaagcaccggctccaggccagcgtgggccgctctctcgctcggtgcccgccgccatgtgggccgtcctgaggttagccctgcggccgtgtgcccgcgcctctcccgccgggccgcgcgcctatcacggggactcggtggcctcgctgggcacccagccggacttgggctctgccctctaccaggagaactacaagcagatgaaagcactagtaaatcagctccatgaacgagtggagcatataaaactaggaggtggtgagaaagcccgagcacttcacatatcaagaggaaaactattgcccagagaaagaattgacaatctcatagacccagggtctccatttctggaattatcccagtttgcaggttaccagttatatgacaatgaggaggtgccaggaggtggcattattacaggcattggaagagtatcaggagtagaatgcatgattattgccaatgatgccaccgtcaaaggaggtgcctactacccagtgactgtgaaaaaacaattacgggcccaagaaattgccatgcaaaacaggctcccctgcatctacttagttgattcgggaggagcatacttacctcgacaagcagatgtgtttccagatcgagaccactttggccgtacattctataatcaggcaattatgtcttctaaaaatattgcacagatcgcagtggtcatgggctcctgcaccgcaggaggagcctatgtgcctgccatggctgatgaaaacatcattgtacgcaagcagggtaccattttcttggcaggaccccccttggttaaagcggcaactggggaagaagtatctgctgaggatcttggaggtgctgatcttcattgcagaaagtctggagtaagtgaccactgggctttggatgatcatcatgcccttcacttaactaggaaggttgtgaggaatctaaattatcagaagaaattggatgtcaccattgaaccttctgaagagcctttatttcctgctgatgaattgtatggaatagttggtgctaaccttaagaggagctttgatgtccgagaggtcattgctagaatcgtggatggaagcagattcactgagttcaaagccttttatggagacacattagttacaggatttgctcgaatatttgggtacccagtaggtatcgttggaaacaacggagttctcttttctgaatctgcaaaaaagggtactcactttgtccagttatgctgccaaagaaatattcctctgctgttccttcaaaacattactggatttatggttggtagagagtatgaagctgaaggaattgccaaggatggtgccaagatggtggccgctgtggcctgtgcccaagtgcctaagataaccctcatcattgggggctcctatggagccggaaactatgggatgtgtggcagagcgtatagcccaagatttctctacatttggccaaatgctcgtatctcagtgatgggaggagagcaggcagccaatgtgttggccacgataacaaaggaccaaagagcccgggaaggaaagcagttctccagtgctgatgaagcggctttaaaagagcccatcattaagaagtttgaagaggaaggaaacccttactattccagcgcaagggtatgggatgatgggatcattgatccagcagacaccagactggtcttgggtctcagttttagtgcagccctcaacgcaccaatagagaagactgacttcggtatcttcaggatgtaactggaataaaggatgttttctgttggacatgtactgaaaattaacacatgtagtagccttaaaattttagacttctcgaacatgaggctgttacagtaatttttttaacactgtgcattgtacttttctaccttaaaaaaatcagtgaggatatttatttaatgaacatcaattccttttaaattttcttagagaaatttctctgtggctcagttttaccaaccc

SEQ ID NO: 117 - DNA, 3747 bp, Homo sapiens
cctcccctggggaggctcgcgttcccgctgctcgcgcctgccgcccgccggcctcaggaacgcgccctctcgccgcgcgcgccctcgcagtcaccgccacccaccagctccggcaccaacagcagcgccgctgccaccgcccaccttctgccgccgccaccacagccaccttctcctcctccgctgtcctctcccgtcctcgcctctgtcgactatcaggtgaactttgaaccaggatggctgagccccgccaggagttcgaagtgatggaagatcacgctgggacgtacgggttgggggacaggaaagatcaggggggctacaccatgcaccaagaccaagagggtgacacggacgctggcctgaaagaatctcccctgcagacccccactgaggacggatctgaggaaccgggctctgaaacctctgatgctaagagcactccaacagcggaagatgtgacagcacccttagtggatgagggagctcccggcaagcaggctgccgcgcagccccacacggagatcccagaaggaaccacagctgaagaagcaggcattggagacacccccagcctggaagacgaagctgctggtcacgtgacccaagagcctgaaagtggtaaggtggtccaggaaggcttcctccgagagccaggccccccaggtctgagccaccagctcatgtccggcatgcctggggctcccctcctgcctgagggccccagagaggccacacgccaaccttcggggacaggacctgaggacacagagggcggccgccacgcccctgagctgctcaagcaccagcttctaggagacctgcaccaggaggggccgccgctgaagggggcagggggcaaagagaggccggggagcaaggaggaggtggatgaagaccgcgacgtcgatgagtcctccccccaagactcccctccctccaaggcctccccagcccaagatgggcggcctccccagacagccgccagagaagccaccagcatcccaggcttcccagcggagggtgccatccccctccctgtggatttcctctccaaagtttccacagagatcccagcctcagagcccgacgggcccagtgtagggcgggccaaagggcaggatgcccccctggagttcacgtttcacgtggaaatcacacccaacgtgcagaaggagcaggcgcactcggaggagcatttgggaagggctgcatttccaggggcccctggagaggggccagaggcccggggcccctctttgggagaggacacaaaagaggctgaccttccagagccctctgaaaagcagcctgctgctgctccgcgggggaagcccgtcagccgggtccctcaactcaaagctcgcatggtcagtaaaagcaaagacgggactggaagcgatgacaaaaaagccaagacatccacacgttcctctgctaaaaccttgaaaaataggccttgccttagccccaaactccccactcctggtagctcagaccctctgatccaaccctccagccctgctgtgtgcccagagccaccttcctctcctaaacacgtctcttctgtcacttcccgaactggcagttctggagcaaaggagatgaaactcaagggggctgatggtaaaacgaagatcgccacaccgcggggagcagcccctccaggccagaagggccaggccaacgccaccaggattccagcaaaaaccccgcccgctccaaagacaccacccagctctggtgaacctccaaaatcaggggatcgcagcggctacagcagccccggctccccaggcactcccggcagccgctcccgcaccccgtcccttccaaccccacccacccgggagcccaagaaggtggcagtggtccgtactccacccaagtcgccgtcttccgccaagagccgcctgcagacagcccccgtgcccatgccagacctgaagaatgtcaagtccaagatcggctccactgagaacctgaagcaccagccgggaggcgggaaggtgcagataattaataagaagctggatcttagcaacgtccagtccaagtgtggctcaaaggataatatcaaacacgtcccgggaggcggcagtgtgcaaatagtctacaaaccagttgacctgagcaaggtgacctccaagtgtggctcattaggcaacatccatcataaaccaggaggtggccaggtggaagtaaaatctgagaagcttgacttcaaggacagagtccagtcgaagattgggtccctggacaatatcacccacgtccctggcggaggaaataaaaagattgaaacccacaagctgaccttccgcgagaacgccaaagccaagacagaccacggggcggagatcgtgtacaagtcgccagtggtgtctggggacacgtctccacggcatctcagcaatgtctcctccaccggcagcatcgacatggtagactcgccccagctcgccacgctagctgacgaggtgtctgcctccctggccaagcagggtttgtgatcaggcccctggggcggtcaataattgtggagaggagagaatgagagagtgtggaaaaaaaaagaataatgacccggcccccgccctctgcccccagctgctcctcgcagttcggttaattggttaatcacttaacctgcttttgtcactcggctttggctcgggacttcaaaatcagtgatgggagtaagagcaaatttcatctttccaaattgatgggtgggctagtaataaaatatttaaaaaaaaacattcaaaaacatggccacatccaacatttcctcaggcaattccttttgattcttttttcttccccctccatgtagaagagggagaaggagaggctctgaaagctgcttctgggggatttcaagggactgggggtgccaaccacctctggccctgttgtgggggttgtcacagaggcagtggcagcaacaaaggatttgaaaactttggtgtgttcgtggagccacaggcagacgatgtcaaccttgtgtgagtgtgacgggggttggggtggggcgggaggccacgggggaggccgaggcaggggctgggcagaggggaggaggaagcacaagaagtgggagtgggagaggaagccacgtgctggagagtagacatccccctccttgccgctgggagagccaaggcctatgccacctgcagcgtctgagcggccgcctgtccttggtggccgggggtgggggcctgctgtgggtcagtgtgccaccctctgcagggcagcctgtgggagaagggacagcgggttaaaaagagaaggcaagcctggcaggagggttggcacttcgatgatgacctccttagaaagactgaccttgatgtcttgagagcgctggcctcttcctccctccctgcagggtagggcgcctgagcctaggcggttccctctgctccacagaaaccctgttttattgagttctgaaggttggaactgctgccatgattttggccactttgcagacctgggactttagggctaaccagttctctttgtaaggacttgtgcctcttgggagacgtccacccgtttccaagcctgggccactggcatctctggagtgtgtgggggtctgggaggcaggtcccgagccccctgtccttcccacggccactgcagtcaccccgtctgcgccgctgtgctgttgtctgccgtgagagcccaatcactgcctatacccctcatcacacgtcacaatgtcccgaattc

SEQ ID NO: 118 - DNA, 2015 bp, Homo sapiens
atgaatagaattggaggaggtatgtataaagatttgtttttttgtatgtacccatcaccatttttaataaactagaaactgtgttgagaattccatgaaaaaaaagtcatggtttattgttggctcatgttctaaaggctgctagcagaaattgagcctggtacatacttaaaggaaggtgatgtgttaagaagtagctgcacaaggtagggtggatgaagagcttactggtgagatttaacatttacaaaacgtacctttcagctacatgactgacagttggatctcaaaattaatctttattccataggaatagggtttggtggtctggaagcaatgaatagcatgggaggatttggaggagttggccgaatgggagagctgtaccgtggtgcgatgactagtagcatggagcgagattttggacgtggtgatattggaataaatcgaggctttggagattcctttggtagacttggtggtggaatgggtagcatgaacagtgtgactggaggaatggggatgggactggaccggatgagttccagctttgatagaatgggaccaggtataggagctatactggaaaggagcatcgatatggatcgaggatttttatcgggtccaatgggaagcggaatgagagagagaataggctccaaaggcaaccagatatttgtcagaaatctaccttttgacttgacttggcagaaactaaaagagaaattcagtcagtgtggtcatgtaatgtttgcagaaataaaaatggagaatggaaagtcaaaaggctgtggaacagtcagatttgactccccagaatcagctgaaaaagcctgcagaataatgaatggcataaaaatcagtggcagagaaattgatgttcgcttggatcgtaatgcataatttcaagccatggttggaacattcctacatctgttttgctgaatctcctagtaaaagtcatttttttaaagtaatattgtatgcttacaaaagctgtaaaaatgaacttttaaaactcccaccagcttttaacagtataatgttaaaaatatactgtaatttttgttaatctcaagtttgggtttttaaagacagcaagtctggtcattcagtttaaatgaatggttatactgtttttaatgaaataagccattttcttgttgttttcagtactacatagttggatttgtttgttctagtttctccagtttttgtcaacttattgtatggtaaaacatagattttttccccccaaacttctgttttataatatgtaatttttcatgaaaagaaagggctcagaaaaattaggatgtgattttggttggttttaaattactgtaagttttagattctaaggttcaagatttttaaaatttgatttaaatgaagaaatggatttttctctctgcccctccctgccattcatattttctgcataacactattaataatatcaacctccacagccccttattttattatttccaataattccaagttcatatagaactgataatgtagcaagccccaagtatgataataggcagactattcccaactttctgtctagtttccagccattgaagtgaactgctaaaaaaagaaaaataattgaaatgttgagagagatggttatgtaagttagtcctctgctgtttacttctgcaggagctgatccatttataaatgcagttttaataaaccatggaataccaaggcacaacatatcaaacacattggatcccacgatgttagacatagccatatctcctttccctacaaaagaaaagcatactgttaaaatgtgcttaccaatactgcgttttattaataatcttcataagaaaagaaacactggatacttttttgttgttgattcgttttgaaaaattgttgttagagcaaaagtcttactgaatttgtatttttaaatttttcttgggttagtatttaaagtcttaacatttatttaataattatatttattaaaccatctttcaataaggtat

SEQ ID NO: 119 - DNA, 3707 bp, Homo sapiens
gtgtgtccctccagtgccgcttgccccttgttctcccaagcaccagggggacccctgtcttagattcaagttgcatcactagactaacagctctgggaacagaggacactgaggactagtttgggaaatgaaaaacatctgcaatgagaggtaattttattctcctcttccttttaccctagtctcactctccatagtaggacctggatctttgcatcagagaaaacataatgaacaataactggaatgtgtgtttctttcttttctgccctagtattactagaacatttgcatcgggaaaaacagaaaaggtgatctttcaagcactcaaggagttaggtcttcccagtggaaagaatgatgaaattgagcccacagcattttcttatgaaaagttctatgaactgacacaaaagatttgtcctcggacagatatagaagatcttttcaaaaaaatcaatggagacaaaactgattatttaacggtagaccaattagtgagctttctaaatgaacatcaacgagatcctcgattgaatgaaattttatttccattttatgatgccaaaagggcaatgcagatcattgagatgtatgaacctgatgaagatttgaagaaaaaaggccttatatcaagtgatgggttttgcagatatctgatgtcagatgaaaacgccccagtcttcctagatcgtttagaactttaccaagaaatggaccatcctctggctcactacttcatcagttcttcccataacacttatctcactggcagacagttcggcgggaagtcttcggtagaaatgtacagacaggttctcctggctggttgcagatgtgttgaacttgactgctgggatggaaaaggtgaggaccaagaaccaataataactcatggaaaagcaatgtgtacagatatcctttttaaggatgtaattcaagccatcaaggaaactgcatttgtcacatcagaatatcctgtaattctctcctttgaaaatcactgcagcaaatatcaacagtacaagatgtccaaatattgcgaagatctatttggggatctcctgttgaaacaagcacttgaatcacatccactggaaccaggcagacctttgccatcccccaatgacctcaaaagaaaaatactcataaaaaacaagcggctgaaacctgaagttgaaaaaaaacagctggaagctttgagaagcatgatggaagctggagaatctgcctccccagcaaacatcttagaggacgataatgaagaggagatcgaaagtgctgaccaagaggaggaagctcaccccgaattcaaatttggaaatgaactttctgctgatgacttgggtcacaaggaagctgttgcaaatagcgtcaagaagggcctggtcactgtagaagatgagcaggcgtggatggcatcttataaatatgtaggtgctaccactaatatccatccatatttgtccacaatgatcaactatgcccagcctgtaaagtttcaaggtttccatgtggcagaagaacgcaatattcattataacatgtcttcttttaatgaatcagtcggtcttggctacttgaagacacatgcaattgaatttgtcaattataacaaacggcaaatgagtcgcatttaccccaagggaggccgagtcgattccagtaattacatgcctcagattttctggaacgctggctgccagatggtttcactgaactatcaaaccccagatttagcgatgcaattgaatcagggaaaatttgagtataatggatcgtgcgggtaccttctcaaaccagatttcatgaggcggcctgatcgaacatttgaccccttctctgaaacgcctgttgatggggttattgcagccacttgctcagtgcaggttatatcaggtcaattcttatcagataagaaaattggcacctacgtagaggtggatatgtatgggttgcccactgacaccatacgtaaggaattccgaactcgcatggttatgaataatggactcaatccagtttacaatgaagagtcacttgtatttcggaaggtgatcctgccggacctggctgtcttgagaatagctgtgtatgatgataacaacaagctgattggccagaggattcctccgcttgatggcctccaagccggatatcgacacatttcccttcgaaatgagggaaataaaccattatcactaccaacaattttctgcaatattgttcttaaaacatatgtgcctgatggatttggagatatcgtggatgctttatcagatccaaagacatttctctcaattacagaaaagagagcagaccaaatgagagctatgggcattgagactagtgacatagccgacgtgcccagtgacacttccaaaaatgacaagaaaggaaaggccaacaccgccaaagcaaatgtgacccctcagagtagctctgagctcagaccaaccaccacggctgccctgccgtctggtgtggaagccaagaaaggtattgaacttatccctcaagtaaggatagaagacttaaagcagatgaaggcttacttgaagcatttaaagaaacagcagaaggagctaaattctttaaagaagaaacatgcaaaggaacacagtaccatgcagaagttacactgcacgcaagttgacaaaattgtggcacagtatgacaaagagaagtcgactcatgagaaaatcctagagaaggcaatgaagaagaaagggggaagtaattgtcttgaaatgaagaaagaaacagaaattaaaattcagacgctgacatcagatcacaaatctaaggtcaaggagattgtagcacagcacacaaaggaatggtcagaaatgatcaatactcacagtgctgaggagcaagaaatccgagacctgcacctcagccagcagtgtgagctgctgaaaaagctactcatcaatgcccacgagcagcaaacccagcagctgaaactgtcccatgacagggaaagcaaggaaatgcgagcacaccaggctaagatttctatggaaaatagcaaagccatcagccaagataaatctatcaagaataaagcagaacgggaaaggcgagtcagggagttaaacagcagcaacactaaaaagtttctggaagaaagaaagagacttgccatgaagcagtccaaagaaatggatcagttgaaaaaagtccagcttgaacatctagaattcctagagaaacagaatgagcaggcgaaggagatgcagcagatggtgaaattggaagccgagatggaccgcagaccagcaacagtagtatgaaactccaaaatgcaaactgaagcagcaaacccacaaagcatcaaaagactcactcacaaaacttctgaacacaaactccatggatgaaagctgtttattttgtttcctttatgtgtaaacaagatgatatctgaaaccagagagacttggaatgtctgactgacttctatttaacagcttgagtattgcatttccttggccaaacaaaaatagctacaaatccacaaaaatttactattccagtaaggcagagtccaaccattgataatacaacttaaacatgtttgctataaaataccatcacaagtaaatgagcttggtgtgaacaactcttcctttgtgatgccttaggacatgttgtaactgcaggcaaaacaaacaaaacagtgcattagcaatttcatagca

SEQ ID NO: 120 - DNA, 1894 bp, Homo sapiens
gtctgacttcctcccagcacattcctgcactctgccgtgtccacactgccccacagacccagtcctccaagcctgctgccagctccctgcaagcccctcaggttgggccttgccacggtgccagcaggcagccctgggctgggggtaggggactccctacaggcacgcagccctgagacctcagagggccaccccttgagggtggccaggcccccagtggccaacctgagtgctgcctctgccaccagccctgctggcccctggttccgctggccccccagatgcctggctgagacacgccagtggcctcagctgcccacacctcttcccggcccctgaagttggcactgcagcagacagctccctgggcaccaggcagctaacagacacagccgccagcccaaacagcagcggcatgggcagcgccagcccgggtctgagcagcgtatcccccagccacctcctgctgccccccgacacggtgtcgcggacaggcttggagaaggcggcagcgggggcagtgggtctcgagagacgggactggagtcccagtccacccgccacgcccgagcagggcctgtccgccttctacctctcctactttgacatgctgtaccctgaggacagcagctgggcagccaaggcccctggggccagcagtcgggaggagccacctgaggagcctgagcagtgcccggtcattgacagccaagccccagcgggcagcctggacttggtgcccggcgggctgaccttggaggagcactcgctggagcaggtgcagtccatggtggtgggcgaagtgctcaaggacatcgagacggcctgcaagctgctcaacatcaccgcagatcccatggactggagccccagcaatgtgcagaagtggctcctgtggacagagcaccaataccggctgccccccatgggcaaggccttccaggagctggcgggcaaggagctgtgcgccatgtcggaggagcagttccgccagcgctcgcccctgggtggggatgtgctgcacgcccacctggacatctggaagtcagcggcctggatgaaagagcggacttcacctggggcgattcactactgtgcctcgaccagtgaggagagctggaccgacagcgaggtggactcatcatgctccgggcagcccatccacctgtggcagttcctcaaggagttgctactcaagccccacagctatggccgcttcattaggtggctcaacaaggagaagggcatcttcaaaattgaggactcagcccaggtggcccggctgtggggcatccgcaagaaccgtcccgccatgaactacgacaagctgagccgctccatccgccagtattacaagaagggcatcatccggaagccagacatctcccagcgcctcgtctaccagttcgtgcaccccatctgagtgcctggcccagggcctgaaacccgccctcaggggcctctctcctgcctgccctgcctcagccaggccctgagatgggggaaaacgggcagtctgctctgctgctctgaccttccagagcccaaggtcagggaggggcaaccaactgccccagggggatatgggtcctctggggccttcgggaccatggggcaggggtgcttcctcctcaggcccagctgctcccctggaggacagagggagacagggctgctccccaacacctgcctctgaccccagcatttccagagcagagcctacagaagggcagtgactcgacaaaggccacaggcagtccaggcctctctctgctccatccccctgcctcccattctgcaccacacctggcatggtgcagggagacatctgcacccctgagttgggcagccaggagtgcccccgggaatggataataaagatactagagaactg

SEQ ID NO: 121 - DNA, 644 bp, Homo sapiens
gcgcgggcggctggggaatggctgctgccatggtgccggggcgcagcgagagctgggagcgcggggagcctggccgcccggccctgtacttctgcgggagcattcgcggcggacgcgaggacaggacgctgtacgagcggatcgtgtctcggctgcggcgattcgggacagtgctcaccgagcacgtggcggccgccgagctgggcgcgcgcggggaagaggctgctgggggtgacaggctcatccatgagcaggacctggagtggctgcagcaggcggacgtggtcgtggcagaagtgacacagccatccttgggtgtaggctatgagctgggccgggccgtggcctttaacaagcggatcctgtgcctgttccgcccgcagtctggccgcgtgctttcggccatgatccggggagcagcagatggctctcggttccaggtgtgggactatgaggagggagaggtggaggccctgctggatcgatacttcgaggctgatcctccagggcaggtggctgcctcccctgacccaaccacttgacttaatctcactttcttaaattcttctattctcagacactgctctagtaccattccttcctcttagccccaggagcaaattaaaaggtacagttaaaatcct

SEQ ID NO: 122 - DNA, 1470 bp, Homo sapiens
gtcctggagctgctgctgctgctgcggctgctgcggcggctgcaccggcggcgccgaggcgagatcgaggccggggtgcgcgcttcgcaaacgtgccctatccgtgcggcttggctgcgccagcccttgcggccacccgggcgtctaggcgggtctgtgcgccgcccgggcgaggatgggctgttccggtggctgctgaagcagccggtgcccaagcagatcgagcgctactcgcgcttttcgccgtcgccgctctccatcaaacaattcctggacttcgggagagataatgcatgtgagaaaacttcatatatgtttctacgaaaggaacttcctgtgcggctggctaacacaatgagagaagttaatcttctgccggataatttacttaaccgcccttcagtgggattggttcagagttggtatatgcagagttttcttgaacttttagaatatgaaaataagagccctgaggatccacaggtcttggataactttctacaagttctgattaaagtcagaaatagacacaatgatgtggttcctacaatggcacaaggagtgattgaatacaaggagaagtttgggtttgatcctttcattagcactaacatccaatattttctggatcggttttataccaaccgcatctctttccgcatgcttattaatcagcacacacttctgtttgggggtgacactaatcctgttcatcctaaacacataggaagtatcgatcccacctgtaacgtggcggatgtggtgaaagatgcatatgaaacagccaagatgctgtgtgaacagtattacctggtagctccagagctggaagttgaagaattcaatgccaaagcgccagacaaacctattcaggtggtttatgtgccctcacatctgtttcatatgctatttgagttgttcaagaactcaatgagagcgacagttgaactctatgaagacagaaaagagggctaccctgctgttaaaaccctcgttactttgggtaaagaagacttatccattaagatcagtgacctaggtggtggtgtcccacttcgaaaaatagatcgtctttttaactacatgtattctactgctcctagacccagcctggagcctaccagagctgcccctttggctggatttggttatggtttgccaatttcccgtctgtatgctagatattttcaaggagatctgaaactgtattccatggaaggagtgggtactgatgctgtcatttatttgaaggctctttcaagtgagtcatttgagagacttccagtttttaataagtccgcatggcgccattacaagaccacgcctgaagccgatgattggagcaatcccagcagtgaacccagggatgcttcaaaatacaaagcaaaacagtaatataccaccttgatttccattacaaagtatctgatttgtctgaataaaggtgtcccactcaaaaaaaaaaaaaaa

SEQ ID NO: 123 - DNA, 3668 bp, Homo sapiens
ggcagagggtgggccttaggacgggtctcccttaaactgggcgatcaggcagcgaccctagaggcgtctgtagggtaaagctgggggttctgtagccggaggcggcggcgagtccagaacgtcctggccttacagggagaaggcgtcactcgcggttacaagtgcctgaccctcactccagttggcggaggaggagaaggaaggggccgggccgggtcccctcccctcgcgccccggatggatgtgcccggcccggtgtctcggcgggcggcggcggcggcggccactgtgctcctgcggaccgctcgggtccgtcgcgaatgctggttcttgccgaccgcgctgctctgcgcctacggcttcttcgccagcctcaggccgtccgagcccttcctgaccccgtacctgctggggccggacaagaacctgaccgagagggaggtcttcaatgaaatttatccagtatggacttactcttacctggtgctactgtttcctgtgttccttgccacagactacctccgttataaacctgttgttctactgcaggggctcagccttattgttacatggtttatgctgctctatgcccagggactgctggccattcaatttctagaatttttttatggcatcgccacagccactgaaattgcctattactcttatatctacagtgtggtggacctgggcatgtaccagaaagtcacaagttactgtcgaagtgccactttggtgggctttacagtgggctctgtcctagggcaaatccttgtctcagtggcaggctggtcgctgttcagcctgaatgtcatctctcttacctgtgtttcagtggcttttgctgtggcctggtttttacctatgccacagaagagcctcttctttcaccacattccttctacctgccagagagtgaatggcatcaaggtacaaaatggtggcattgttactgacaccccagcttctaaccaccttcctggctgggaggacattgagtcaaaaatccctctaaatatggaggagcctcccgtggaggaaccggaacccaagccagaccgtctccttgtattgaaagtactatggaatgatttcctgatgtgctactcctctcgccctcttctctgctggtctgtgtggtgggccctctctacctgtggctattttcaagttgtgaactacacacagggcctgtgggagaaagtgatgccttctcgctatgctgctatctataatggtggcgtggaggccgtttcaaccttactgggtgctgttgctgtgtttgcagttggttatataaaaatatcctggtcaacttggggagaaatgacattatctctcttttctctcctgattgctgctgcagtgtatatcatggacactgtgggtaacatttgggtgtgctatgcatcctatgttgtcttcagaatcatctacatgttactcatcacgatagcaacttttcaaattgctgcaaacctcagcatggaacgctatgccctagtatttggtgtaaataccttcattgccctggcactgcagacgctgctcactctaattgtggtagatgccagtggccttggattagaaattaccactcagtttttgatctatgccagttattttgcactcatcgctgtggttttcctggccagtggtgcagtcagtgttatgaagaaatgtagaaagctggaagatccacaatcaagttctcaagtaaccacttcataatatactgctgaagggcttcttcttatagcaagaactctgcacagcaactgcctggatgtatttgattttttaaagcgtagacatatatttatgaatgtgcatttcttgacttcacagcagccacttgactaataccttgtgttccgggaataacatgatactattcagaggagccagaagtaaagtttatttcatggattatttatgagagctaatttaaggatgactttttttctgattcaaaagtgaacttgattttaaaaaccagtcaagagcaatcaaagcagcacatggtgttgtatacttcattagcaagtgagtttggtgttttataggtcacatatgtctgtatctacttagccagatgcttggcctggtgggaccagggctccacagaggccacaaaatgttgcaagtcatgatggatggaaatatgttctaacagcatctgcctctattcaatttaattcttatttctgtgttactcatgtacattggtctttctacatagttattctatcactggcaatatttgttctggtttagtgttctgtattttaaggtgtacgtatcatttctaattttaagttattttaaaaaaattcatcatatgaatgttcttggttcccattgtgacgattatttatttctgtaaaatttgtttagaagtacgtttttgcattattcatatgcttcccagagaagctcatttagttagaaaataaggcaagttttgaagcctgctaaatgaagagacttaagaaagcttaaggtacgcttgcttgtctttaaatcttcaatatgaaggactattaattccaagattaaaagttcatatataggctaaagatgtaactaggccatttgtatttgtattcccttttatttccaaaataaaatgaaaaatctttttttaataatttcatccctatttatagtttttatattaatttgtttttcttatccaagtaaagatgtcaataggaattgcattagtccaaggcctttttcataaactgagcctcttttcaattatttcaatgggacaggaactaggatagatgtgattcctgcatttttttaccttaaatctgcctttgtttctaaaggtagatcatcttgaatatttgcttaaaattgctagtgatttcattaccaagttacttgaaaaaatgttctatatgcatttaattctgaaatcagtctaccaaggggctgctagtatatgtcagacatgaaaactattttaaagctgactttgttgccttatcttgaaaagaatctagataggtgcttttaactggggtattaacttttttagaatgacacagctgaacagtgttaataatagtgtgtcaagattgcaaagtcgacatactcatttggtttaagcaggaatcctagaagcaaatggatggggataagaataggtcattttctattcaccatcctttactattaagggaaaggaaaagaacactagctaaggaagggaaagggaagtgatatcataaaagtagcaaccttcattttacattctgtctgtttttctttttttgctttgttttgtttgtgctaatttgggaattgtgtactccgaaacaagtagaaaagtgctgtttgagggattttattaaatctttttttaatggaatgtggtacaaattgttcatgttaccaaagcaatatttccctggaatttaattcaaagtttgtggcatacaacctgagccttttcttatataagacaagaatatgttcacatcttggtatgtggccatatttatagaatgctgaactcaatgtgcaagttgtactgtatgcagttttgtaaataagtgaaaataatttgttgtactttttattcaattctgtatagattataaaattatttttattaaataaatattttacagtataaaaaaaaaaaaaaaaaa

SEQ ID NO: 124 - DNA, 1334 bp, Homo sapiens
ggcacgagggggcgctcctgagcttcgcggggccgcagtccgggatgcctgcgcgaagggaggggcgaagggccggccgttgccgacgtgggtgttaagtggccgccccagccggcgacccggagccgagagcgggcggcggagcctgagctggacgcggccacgccggcgcggcgggatatgtggtgcctgtcataagctccagagagctgccttccacaagaccagcagaagagtgggcaaacatgaaatccaatcctgctatccaggctgccattgacctcacagcgggggctgcaggaggtacagcatgtgtactgaccgggcagccctttgacacaatgaaagtgaagatgcagacgttccctgacctgtaccggggcctcaccgactgctgcctgaagacttactcccaggtgggcttccgtggcttctacaagggtaccagtccagcactaatcgccaacatcgctgagaactcagtcctcttcatgtgctacggcttctgccagcaggtggtgcggaaagtggctggattggacaagcaggcaaagctgagtgatctgcagaatgcagccgccggttccttcgcctctgcctttgctgcactggtgctctgccccacggagctcgtgaagtgccggctgcagaccatgtatgagatggagacatcagggaagatagccaagagccagaatacagtgtggtctgtcatcaaaagtattcttaggaaagatggccccttggggttctaccatggactctcaagcactttacttcgagaagtaccaggctatttcttcttcttcggtggctatgaactgagccggtccttttttgcatcagggagatcaaaagatgaattaggccctgtacctttgatgttaagtggtggagttggtgggatttgcctctggcttgcggtatacccagtggattgtatcaaatccagaattcaagttctttccatgtctggaaaacaggcaggatttatcagaacctttttaaatgttgtgaaaaatgaaggaataacggccttatattctggactgaaacctactatgattcgagcattccctgccaatggagcactctttttggcctacgaatatagcaggaagttgatgatgaaccagttggaagcatactgaagtgtcttggtgggcctgagccaagcacaggtgtttgaggactacagttcatctcagggtttcttggagtacaagaccagtgtgaagttattctgatttcttgggaattttgctttttgtcttcccttctaccctacatcttaaactttatggaagaacctcaaaaaaaaaaaaaaaaaaaaa

SEQ ID NO: 125 - DNA, 1883 bp, Homo sapiens
agttccgcgcggggctgtcggggaaccatggctgccccgagagacaatgtcactttattattcaagttatactgcttggcagtgatgaccctgatggctgcagtctataccatagctttaagatacacaaggacatcagacaaagaactctacttttcaaccacagccgtgtgtatcacagaagttataaagttattgctaagtgtgggaattttagctaaagaaactggtagtctgggtagattcaaagcatctttaagagaaaatgtcttggggagccccaaggaactgttgaagttaagtgtgccatcgttagtgtatgctgttcagaacaacatggctttcctagctcttagcaatctggatgcagcagtgtaccaggtgacctaccagttgaagattccgtgtactgctttatgcactgttttaatgttaaaccggacactcagcaaattacagtgggtttcagtttttatgctgtgtgctggagttacgcttgtacagtggaaaccagcccaagctacaaaagtggtggtggaacaaaatccattattagggtttggcgctatagctattgctgtattgtgctcaggatttgcaggagtatattttgaaaaagttttaaagagttcagatacttctctttgggtgagaaacattcaaatgtatctatcagggattattgtgacattagctggcgtctacttgtcagatggagctgaaattaaagaaaaaggatttttctatggttacacatattatgtctggtttgtcatctttcttgcaagtgttggtggcctctacacttctgttgtggttaagtacacagacaacatcatgaaaggcttttctgcagcagcggccattgtcctttccaccattgcttcagtaatgctgtttggattacagataacactcacctttgccctgggtactcttcttgtatgtgtttccatatatctctatggattacccagacaagacactacatccatccaacaaggagaaacagcttcaaaggagagagttattggtgtgtgattttagcctcacgtgagactccttttaagactaaaccatttgcattaaactagagccttaagtcaatctcagaaggtagcataaacaaataaaaattaactgtatggcatgatcagtgcggttatgtggaaacaacaacaaacaaacgaagctatctgagtgaactgctaatacagaaacttaatgtagacctgtttggggtctactattgttttagaatgaaggaattgtattattgtgtgtatatataatttgtaaataaaaagtatggagatgatacggtgttaaaaaaaatcatggtgaggctacaatactcaagtaacaaggtttgggacaatgtctaagggttaaagtgccaaagccatttctgtactaactgttctcttgttccggtaccggggagaaggatgacccctccttattctccaattcatgtacagtattttgtcctagcagcataaagacctagctcttttcttacaagaggcagaaacaagacaggctagttcataaacaaactgaatgtgtaactaacttctcaaaatgaatctatttcataactcggacaatttctgggtggtgactgagtacccctttagtgagtacccctttagtgctatatttgtgccattcattatctggttcatatttctttgctgttagatgatacacatttcttcaaaaaaatttctaatgtcacttttgtacttttttaaataaagtatgtttaactgttgggctctcaataatttgtgaaatttcagtgttttctataatgttaatggggaaattcagcaataaactttatttgcaaaaaaaaaaaaaaaaaaaaaaaaaaaaaa

SEQ ID NO: 126 - DNA, 3000 bp, Homo sapiens
ctgaggggaggagaccgcgcgcgggacggggaggaatggcctgtccgcgttaaaccatcacaagccatggttgcggaagggccacgcgtcccccagtaggagaatgactccgattcgtgaccctcagcgccggtgcatgtcgatatatttattgagtgtctactgtgtgccaggcactatatctatgtgcatagaaaaaccctggaaggccatacaacaatatatatagagtgatcgtctctgcttgctgagctaacaggggtgtcaagcttccattttggtatctacttctaaatacactcagaacaggagaaatttggactaattttcaaactacagacactttctaatcatgatgcatttcaaaagtggactcgaattaactgagttgcaaaacatgacagtgcccgaggatgataacattagcaatgactccaatgatttcaccgaagtagaaaatggtcagataaatagcaagtttatttctgatcgtgaaagtagaagaagtctcacaaacagccatttggaaaaaaagaagtgtgatgagtatattccaggtacaacctccttaggcatgtctgtttttaacctaagcaacgccattatgggcagtgggattttgggactcgcctttgccctggcaaacactggaatcctactttttctggtacttttgacttcagtgacattgctgtctatatattcaataaacctcctattgatctgttcaaaagaaacaggctgcatggtgtatgaaaagctgggggaacaagtctttggcaccacagggaagttcgtaatctttggagccacctctctacagaacactggagcaatgctgagctacctcttcatcgtaaaaaatgaactaccctctgccataaagtttctaatgggaaaggaagagacattttcagcctggtacgtggatggccgcgttctggtggtgatagttacctttggcataattctccctctgtgtctcttgaagaacttagggtatcttggctatactagtggattttccttgagctgtatggtttttttcctaattgtggttatttacaagaaatttcaaattccctgcattgttccagagctaaattcaacaataagtgctaattcaacaaatgctgacacgtgtacgccaaaatatgttaccttcaattcaaagaccgtgtatgctttacccaccattgcatttgcatttgtttgccacccgtcagtcctgccaatttacagtgagcttaaagaccgatcacagaaaaaaatgcagatggtttcaaacatctcctttttcgccatgtttgttatgtacttcttgactgccatttttggctacttgacattctatgacaacgtgcagtccgacctccttcacaaatatcagagtaaagatgacattctcatcctgacagtgcggctggctgtcattgttgctgtgatcctcacagtgccggtgttatttttcacggttcgttcatctttatttgaactggctaagaaaacaaagtttaatttatgtcgtcataccgtggttacctgcatactcttggttgttatcaacttgttggtgatcttcataccctccatgaaggatatttttggagtcgtaggagttacatctgctaacatgcttattttcattcttccttcatctctttatttaaaaatcacagaccaggatggagataaaggaactcaaagaatttgggctgcccttttcttgggcctgggggtgttgttctccttggtcagcattcccttggtcatctatgactgggcctgctcatcgagtagtgacgaaggccactgaaacccgccgagaaaaagaaacatccctgttgtctgctcagtcaagtccccacacatcagcaatctctcaccacttcttttgcaagtttacagaagcaaacagaaatgtacaggatacttaaaatggaataactttttggttgcaaaacagagacatggttctataatgcttcatgtccctccaagatttgagatcaatttagggattgtgaaatttttttttcaaatttcatacaatcatatttcccagtacttttcacaatcattttttacccatctaactctatgttttgtggcttcccggtctcttagaactttgaaaacatgatatacaataatgtttatttattatacatccagattctgaaataattttcctactgatgttcagctcacactatctgtacctttttagaagagaaaagaatcttgaattgtatatatttattttgctttacagaaaaaaatggtttcgtaaataatttgcctattttggttaacatagcacatggagataatcatctgaaagttatagggcactgccactgctgaatcagagcatgcccaatatttgaggtggctctgatttcctggcagctgaactcgggtagtccagtggcctagctggtaccacatctattcccatccagagacattctctggcaagtgttctcagctgaaaagtggttggggatgattcttaccttggtaattaaatgaagctacacatttgggtaatctagcaaatgaagtattttttccctcttggcaacttgtgtcagagttactctggtctgagtcaactttcgctggggaaaacctatggaacctactgcaaaaagattgtccaaaatgcctaagaaaatactcctctgatgcatttagccttcaaccctacctgtcttgctgaagggagaaaaatgttttagtacattataggcccagcagcttttattcatgtccaccagctagttgcacagagaatcatgtgtacctaactaaggatgatctaggataagtaactcctgttttatattgagtattttagggaagtctttaaaagacttgttttatatctataaatctaggttattacaaatacaagaattttgtaccttaaataagcctcatttctatttcttcttcattaattctccatctagtcttgtgaaaaaaaaaaaaaaa

SEQ ID NO: 127 - DNA, 2165 bp, Homo sapiens
ctgagcgacagcaagtgcagcgggctcctaccccgggtgaggggtggcctccgcgtgggatcgtgccctcttcagcccgctcctgtccccgacatcacgtgtattccgcacgtcccctccgcgctgtgtgtctactgagacggggaggcgtgacagggcccgggtcccttctcagtggtgctctgtgcttcagggcaagctccccgtctccgggcgcacttccctcgcctgtgttcggtccatcctcctttctccagcctcctcccctcgcaggtgggatcgtcggtgggaccggagcgcgggcgggcgcggccccccgggaccatggccgggtccgacaccgcgcccttcctcagccaggcggatgacccggacgacgggccagtgcctggcaccccggggttgccagggtccacggggaacccgaagtccgaggagcccgaggtcccggaccaggaggggctgcagcgcatcaccggcctgtctcccggccgttcggctctcatagtggcggtgctgtgctacatcaatctcctgaactacatggaccgcttcaccgtggctggcgtccttcccgacatcgagcagttcttcaacatcggggacagtagctctgggctcatccagaccgtgttcatctccagttacatggtgttggcacctgtgtttggctacctgggtgacaggtacaatcggaagtatctcatgtgcgggggcattgccttctggtccctggtgacactggggtcatccttcatccccggagagcatttctggctgctcctcctgacccggggcctggtgggggtcggggaggccagttattccaccatcgcgcccactctcattgccgacctctttgtggccgaccagcggagccggatgctcagcatcttctactttgccattccggtgggcagtggtctgggctacattgcaggctccaaagtgaaggatatggctggagactggcactgggctctgagggtgacaccgggtctaggagtggtggccgttctgctgctgttcctggtagtgcgggagccgccaaggggagccgtggagcgccactcagatttgccacccctgaaccccacctcgtggtgggcagatctgagggctctggcaagaaatcctagtttcgtcctgtcttccctgggcttcactgctgtggcctttgtcacgggctccctggctctgtgggctccggcattcctgctgcgttcccgcgtggtccttggggagaccccaccctgccttcccggagactcctgctcttcctctgacagtctcatctttggactcatcacctgcctgaccggagtcctgggtgtgggcctgggtgtggagatcagccgccggctccgccactccaacccccgggctgatcccctggtctgtgccactggcctcctgggctctgcacccttcctcttcctgtcccttgcctgcgcccgtggtagcatcgtggccacttatattttcatcttcattggagagaccctcctgtccatgaactgggccatcgtggccgacattctgctgtacgtggtgatccctacccgacgctccaccgccgaggccttccagatcgtgctgtcccacctgctgggtgatgctgggagcccctacctcattggcctgatctctgaccgcctgcgccggaactggcccccctccttcttgtccgagttccgggctctgcagttctcgctcatgctctgcgcgtttgttggggcactgggcggcgcagccttcctgggcaccgccatcttcattgaggccgaccgccggcgggcacagctgcacgtgcagggcctgctgcacgaagcagggtccacagacgaccggattgtggtgccccagcggggccgctccacccgcgtgcccgtggccagtgtgctcatctgagaggctgccgctcacctacctgcacatctgccacagctggccctgggcccaccccacgaagggcctgggcctaaccccttggcctggcccagcttccagagggaccctgggccgtgtgccagctcccagacactacatgggtagctcaggggaggaggtgggggtccaggagggggatccctctccacaggggcagccccaagggctcggtgctatttgtaacggaataaaatttgtgccagaaaaaaaaaaaa

SEQ ID NO: 128 - DNA, 1443 bp, Homo sapiens
ggcaggtgcaggcgccgcggggccggatcctccgcgcggccgagtccatctcctgggaaatggggcggacagtgtttccttgactgactattgtgagcgccctctctctccggcggagcggagaccatggcccccactcagggcccccgggccccgctggaattcggagggcccctgggcgccgcggctctgctactgctgctgcccgccaccatgttccacctgctcctggcggcccgttcgggccccgcgcgcctgctgggtccacccgcgtccctgcccgggctggaggtgctgtggagcccacgggcgctgctgctgtggctcgcctggctcggcctgcaggcggcgctctacctactgccggcgcgcaaggtggccgaagggcaggaattgaaggacaagagtcgcctgcgctatcctattaacggcttccaggccctggtgctgacagccctgttggtggggctggggatgtcagcggggctgcctctgggggcgctcccggaaatgctcctgcccttggcgtttgtcgccaccctcaccgctttcatcttcagcctctttctctacatgaaggcgcaggtagccccagtttcggccctggcacctggggggaactcaggcaatccgatttacgacttttttctgggacgagagctcaaccctcgtatctgtttcttcgacttcaaatatttctgtgaactgcgacccggcctcatcggctgggtcctcatcaacctggccctgttgatgaaggaggcagagcttcgaggcagtccctcactggccatgtggctggtcaatggcttccagttgctctacgtgggtgatgccctctggcacgaggaggccgtcctcaccaccatggatatcacacatgacgggtttggcttcatgctggcgtttggggacatggcctgggtgcccttcacctacagcctgcaggcccagttcctgctgcaccacccgcagcccctggggttgcccatggcctctgtcatctgcctcatcaatgctattggttactacatcttccgtggggcgaattcccagaaaaacactttccgaaagaatccttctgaccccagagtggctgggcttgagaccatctctacagccacagggcggaaactgctggtgtctgggtggtggggtatggtccgccatcccaactatcttggagacctcatcatggctctggcttggtccttgccctgcggggtgtcacacctgctgccctacttctacctcctctacttcaccgcgctgctggtgcaccgtgaggcccgggatgagcggcagtgcctgcagaagtacggcctggcctggcaggagtactgccggcgtgtgccttaccgcatcatgccctacatctactgaggatgaacaacctcagagaagaggtggtttagagcaaggaaaaaaatgaaaccagtgacc

SEQ ID NO: 129 - DNA, 2596 bp, Homo sapiens
aatgaagaacagctggaagatatgagacaggaacttgtacgacaataccaagaacatcaacaggcaacggaattgttaaggcaagcacatatgcggcagaaggagagacaatgaccaagacagacaagagctcgagtggggctaaaaagaaggacttctccagcaagggagccgaggataatatggtaacgagctataattgtcagttctgtgacttccgatattccaaaagccatggccctgatgtaattgtagtggggccacttctccgtcattatcaacagctccataacattcacaagtgtaccattaaacactgtccattctgtcccagaggactttgcagcccagaaaagcaccttggagaaattacttatccgtttgcttgtagaaaaagtaattgttcccactgtgcactcttgcttctgcacttgtctcctggggcggctggaagctcgcgagtcaaacatcagtgccatcagtgttcattcaccacccctgacgtagatgtactcctctttcactatgaaagtgtgcatgagtcccaagcatcggatgtcaaacaagaagcaaatcacctgcaaggatcggatgggcagcagtctgtcaaggaaagcaaagaacactcatgtaccaaatgtgattttattacccaagtggaagaagagatttcccgacactacaggagagcacacagctgctacaaatgccgtcagtgcagttttacagctgccgatactcagtcactactggagcacttcaacactgttcactgccaggaacaggacatcactacagccaacggcgaagaggacggtcatgccatatccaccatcaaagaggagcccaaaattgacttcagggtctacaatctgctaactccagactctaaaatgggagagccagtttctgagagtgtggtgaagagagagaagctggaagagaaggacgggctcaaagagaaagtttggaccgagagttccagtgatgaccttcgcaatgtgacttggagaggggcagacatcctgcgggggagtccgtcatacacccaagcaagcctggggctgctgacgcctgtgtctggcacccaagagcagacaaagactctaagggatagtcccaatgtggaggccgcccatctggcgcgacctatttatggcttggctgtggaaaccaagggattcctgcagggggcgccagctggcggagagaagtctggggccctcccccagcagtatcctgcatcgggagaaaacaagtccaaggatgaatcccagtccctgttacggaggcgtagaggctccggtgttttttgtgccaattgcctgaccacaaagacctctctctggcgaaagaatgcaaatggcggatatgtatgcaacgcgtgtggcctctaccagaagcttcactcgactcccaggcctttaaacatcattaaacaaaacaacggtgagcagattattaggaggagaacaagaaagcgccttaacccagaggcacttcaggctgagcagctcaacaaacagcagaggggcagcaatgaggagcaagtcaatggaagcccgttagagaggaggtcagaagatcatctaactgaaagtcaccagagagaaattccactccccagcctaagtaaatacgaagcccagggttcattgactaaaagccattctgctcagcagccagtcctggtcagccaaactctggatattcacaaaaggatgcaacctttgcacattcagataaaaagtcctcaggaaagtactggagatccaggaaatagttcatccgtatctgaagggaaaggaagttccgagagaggcagtcctatagaaaagtacatgagacctgcgaaacacccaaattattcaccaccaggcagccctattgaaaagtaccagtacccactttttggacttccctttgtacataatgacttccagagtgaagctgattggctgcggttctggagtaaatataagctctccgttcctgggaatccgcactacttgagtcacgtgcctggcctaccaaatccttgccaaaactatgtgccttatcccaccttcaatctgcctcctcatttttcagctgttggatcagacaatgacattcctctagatttggcgatcaagcattccagacctgggccaactgcaaacggtgcctccaaggagaaaacgaaggcaccaccaaatgtaaaaaatgaaggtcccttgaatgtagtaaaaacagagaaagttgatagaagtactcaagatgaactttcaacaaaatgtgtgcactgtggcattgtctttctggatgaagtgatgtatgctttgcatatgagttgccatggtgacagtggacctttccagtgcagcatatgccagcatctttgcacggacaaatatgacttcacaacacatatccagaggggcctgcataggaacaatgcacaagtggaaaaaaaatggaaaacctaaagagtaaaaccttagcacttagcacaattaaatagaaataggttttcttgatgggaattcaatagcttgtaatgtcttatgaagacctattaaaaaaatacttcatagagcctgccttatccaacatg

SEQ ID NO: 130 - DNA, 487 bp, Homo sapiens
ttttttttgttctcaacttgtttaatatggaaaaaggtcatcaaaacggtaggcaggttgctgtttttaatacattcttgggatgttggccattcagacagcattatttcaaatatagatgagttatccaactttttttgactcaaagatagtttgcttagattttttttttttgagatggagtcttgctctgtcaccaggctggagtgtagtggcgtgatctcagctcaccgcaacctccgcctcccaggttcaagcaattctcctacctcagcctcccaagtagctgggactacaggcatgcaccaccacacccagctaatttttgtatttttagtagagacagggtttcaccatgttggccaggatggtctcgatctcttgacctcgtgatcagcccgccttggcctcccaaagtgctgggattacaggcgtgagccactgcgcccggactagattttaacaagacctaattccatgggattat

SEQ ID NO: 131 - DNA, 569 bp, Homo sapiens
  misc_feature (476)..(476): n is a, c, g, or t
tttttttttttttttttaaattagttattgtcattcttaaaaaatcaggaaattttagatgtaagtgtggaatcgccagcaacaatgggcccacatttcaggtacatcagaactgacggcctctgttagagagggcatgcctgctcctgttccctcagaatcaatccttacccatcacattgtcttacattagggcccacttgactcatttaaataggtagctgcctggttcttgagtctgaaatccctgtcttaaaggatgatgaaaacaatggtttacgtctattctactttcttattaggcctcaccgatgtgcagtataaaacacctctctaatcttttcccatgtaatgtatcaccatttcaaagtgagatctctgcaggcttccatcagcttatgctatcacaccctatttaaaattaatacagcaatagctcaagagccaggctgaagaataagactggtggctttcanggatgtgaggaaagaaccctccactattatgaattactattgcattatgtttcctcttcaaagaccaaatatcagaaatgaaaggctgatatt

SEQ ID NO: 132 - DNA, 4574 bp, Homo sapiens
gagcgggcgagggagcgcgcgcggccgccacaaagctcgggcgccgcggggctgcatgcggcgtacctggcccggcgcggcgactgctctccgggctggcgggggccggccgcgagccccgggggccccgaggccgcagcttgcctgcgcgctctgagccttcgcaactcgcgagcaaagtttggtggaggcaacgccaagcctgagtcctttcttcctctcgttccccaaatccgaggcagcccgcgggcgtcatgcccgcgctcctccgcagcctggggtacgcgctgaagcccgggaggcttggcgccggcgaagacccaaggaccactcttctgcgtttggagttgctccccacaaccccgggctcgtcgctttctccatcccgacccagccggggcgcggggacaacacaggtcgcggaggagcgttgccattcaagtgactgcagcagcagcggcagcgcctcggttcctgagcccaccgcaggctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaagagccaccaaccaaataccaaatctctcaaccagaagtgtacgtggctgcgccaggggagtcgctagaggtgcgctgcctgttgaaagatgccgccgtgatcagttggactaaggatggggtgcacttggggcccaacaataggacagtgcttattggggagtacttgcagataaagggcgccacgcctagagactccggcctctatgcttgtactgccagtaggactgtagacagtgaaacttggtacttcatggtgaatgtcacagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtggtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaagcactcggggataaatagttccaatgcagaagtgctggctctgttcaatgtgaccgaggcggatgctggggaatatatatgtaaggtctccaattatatagggcaggccaaccagtctgcctggctcactgtcctgccaaaacagcaagcgcctggaagagaaaaggagattacagcttccccagactacctggagatagccatttactgcataggggtcttcttaatcgcctgtatggtggtaacagtcatcctgtgccgaatgaagaacacgaccaagaagccagacttcagcagccagccggctgtgcacaagctgaccaaacgtatccccctgcggagacaggtaacagtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaatgtattcatcgagatttagcagccagaaatgttttggtaacagaaaacaatgtgatgaaaatagcagactttggactcgccagagatatcaacaatatagactattacaaaaagaccaccaatgggcggcttccagtcaagtggatggctccagaagccctgtttgatagagtatacactcatcagagtgatgtctggtccttcggggtgttaatgtgggagatcttcactttagggggctcgccctacccagggattcccgtggaggaactttttaagctgctgaaggaaggacacagaatggataagccagccaactgcaccaacgaactgtacatgatgatgagggactgttggcatgcagtgccctcccagagaccaacgttcaagcagttggtagaagacttggatcgaattctcactctcacaaccaatgaggaatacttggacctcagccaacctctcgaacagtattcacctagttaccctgacacaagaagttcttgttcttcaggagatgattctgttttttctccagaccccatgccttacgaaccatgccttcctcagtatccacacataaacggcagtgttaaaacatgaatgactgtgtctgcctgtccccaaacaggacagcactgggaacctagctacactgagcagggagaccatgcctcccagagcttgttgtctccacttgtatatatggatcagaggagtaaataattggaaaagtaatcagcatatgtgtaaagatttatacagttgaaaacttgtaatcttccccaggaggagaagaaggtttctggagcagtggactgccacaagccaccatgtaacccctctcacctgccgtgcgtactggctgtggaccagtaggactcaaggtggacgtgcgttctgccttccttgttaattttgtaataattggagaagatttatgtcagcacacacttacagagcacaaatgcagtatataggtgctggatgtatgtaaatatattcaaattatgtataaatatatattatatatttacaaggagttattttttgtattgattttaaatggatgtcccaatgcacctagaaaattggtctctctttttttaatagctatttgctaaatgctgttcttacacataatttcttaattttcaccgagcagaggtggaaaaatacttttgctttcagggaaaatggtataacgttaatttattaataaattggtaatatacaaaacaattaatcatttatagttttttttgtaatttaagtggcatttctatgcaggcagcacagcagactagttaatctattgcttggacttaactagttatcagatcctttgaaaagagaatatttacaatatatgactaatttggggaaaatgaagttttgatttatttgtgtttaaatgctgctgtcagacgattgttcttagacctcctaaatgccccatattaaaagaactcattcataggaaggtgtttcattttggtgtgcaaccctgtcattacgtcaacgcaacgtctaactggacttcccaagataaatggtaccagcgtcctcttaaaagatgccttaatccattccttgaggacagaccttagttgaaatgatagcagaatgtgcttctctctggcagctggccttctgcttctgagttgcacattaatcagattagcctgattctcttcagtgaattttgataatggcttccagactctttgcgttggagacgcctgttaggatcttcaagtcccatcatagaaaattgaaacacagagttgttctgctgatagttttggggatacgtccatctttttaagggattgctttcatctaattctggcaggacctcaccaaaagatccagcctcatacctacatcagacaaaatatcgccgttgttccttctgtactaaagtattgtgttttgctttggaaacacccactcactttgcaatagccgtgcaagatgaatgcagattacactgatcttatgtgttacaaaattggagaaagtatttaataaaacctgttaatttttatactgacaataaaaatgtttctacagatattaatgttaacaagacaaaataaatgtcacgcaactt

SEQ ID NO: 133 - DNA, 549 bp, Homo sapiens
tttttttttatgtttcgatagattgggaaagctaaagaaactcccatacacaccttggtaccaccaatcaacttaaacatgacatcctcagagagacagtctcagatcatccaattagcaccttctattatttatttacttcctagacacttgtcgaaatctgaaaattctttattcgttggtttgtctatattgacagactgtaactggatgaaggcaagagaccttgtcttgtacatagttgtgtcctcagcacttggcagaatgtctagatggagcaggtgcttaaatacttgttgaaaaaataaaaactgcaactgcaggggtttttaaatatataaacataaaaatattactcatcaaaatttaagtaatatagctaaagctatgctcagaggaacattcaataggattacatttttacattataaaacataaaatattataaaagttgcaattttattaagttaaaaaattcaaaactggccaggcacagtgggtcacgcctgtaatcccagcactttgggaggccgaggtgggtagatcacc

SEQ ID NO: 134 - DNA, 799 bp, Homo sapiens
tcgcctcgcacccccagccagtccgtcgatccagctgccagcgcagccgccagcgccggcacatcccgctctgggctttaaacgtgacccctcgcctcgactcgccctgccctgtgaaaatgttggtgcttcttgctttcatcatcgccttccacatcacctctgcagccttgctgttcattgccaccgtcgacaatgcctggtgggtaggagatgagttttttgcagatgtctggagaatatgtaccaacaacacgaattgcacagtcatcaatgacagctttcaagagtactccacgctgcaggcggtccaggccaccatgatcctctccaccattctctgctgcatcgccttcttcatcttcgtgctccagctcttccgcctgaagcagggagagaggtttgtcctaacctccatcatccagctaatgtcatgtctgtgtgtcatgattgcggcctccatttatacagacaggcgtgaagacattcacgacaaaaacgcgaaattctatcccgtgaccagagaaggcagctacggctactcctacatcctggcgtgggtggccttcgcctgcaccttcatcagcggcatgatgtacctgatactgaggaagcgcaaatagagttccggagctgggttgcttctgctgcagtacagaatccacattcagataaccattttgtatataatcattattttttgaggtttttctagcaaacgtattgtttcctttaaaagccaaaaaaaaaaaaaaaaaaaaaaaaaaaaaaaaaaaagaaaaaaaaaaaaaaaaaaaaa

SEQ ID NO: 135 - DNA, 561 bp, Homo sapiens
  misc_feature (368)..(368): n is a, c, g, or t
ttttaggacaaataaaatttatttttctctgtaaattcatttaaaagtatgttatctatgattatcctatcaagggcagaaatgttagatcttactccaagataggtaaacgcctttgaaacgcaacaaaaagagacgatgatcttatgagctcatttatgttcatgcgtgaaagtgtgaaggtcactagctttgctgtgtttctacaagtttccttgactgtaaaaacagtcaaaatgtaaccaacctaattcaagatgttaaattaattaagttaaataaaattagccaaagcactgtaaattaaatgacataatacttaagttctgtactgatgacaccctttgatcaaaagaaggtggacccantaaggtgcttctggaggttattacttctctaattccgaatttatcatcactgactctttaggcataataaaatgtagagtgtaaataggttggtgacaatttatttaatttaggttgagctacttataaatacctgagagctctggaaacaacatatatatccatcttgcaaatatcagtaaaaagaacaagt

SEQ ID NO: 136 - DNA, 567 bp, Homo sapiens
  misc_feature (61)..(61): n is a, c, g, or t
  misc_feature (432)..(432): n is a, c, g, or t
  misc_feature (441)..(441): n is a, c, g, or t
  misc_feature (465)..(465): n is a, c, g, or t
  misc_feature (495)..(495): n is a, c, g, or t
  misc_feature (501)..(501): n is a, c, g, or t
  misc_feature (532)..(532): n is a, c, g, or t
  misc_feature (559)..(559): n is a, c, g, or t
tttttttaagagaacctgaattaaatttttaatattttaaaaaaggaaagttgctgggaantggtaaacagaaacagaagattagaggcctaactagaaagagacactggtgttagcagagagatattgaggggctgtaagctaaaggtttgaaatctaaagatagagtggaaaagggagtaggcacccccaccagcccctgcttgacatctgctttagttcattccagcaggaaggaggagaagggcagggaggtagggagcttctcagcaaagccagcttcagctttgataatctcacccacctaccccatttaaggagttccaggtttaagagtttaaaaacaggtggcaccagaccatcattcaggagacaggaactcattccaggttcctaagagaactcctatctcagacctgaaggggtttccanggcttcagnttgagctcctctgggctaaccagnagtcacttgattaagtcccgctgccttgancccatnttccaggagggggctattgcccgagggagtntaagggagttccagcccccaagccttnttaggcac

SEQ ID NO: 137 - DNA, 1551 bp, Homo sapiens
aaaacatgttgatcccaatgatgtgatcacttttgaacctttccattacaaagcattgtatagataactttttaattcagtaggaggagaaagttcattcttggcctgttggctttgattattatgggtactttaaagtcagtatttatcaagaaagggaacttgaccaccattggcacatgtgacatttaagctcttcagccttttcctttttagttgtaggtgtttacatttcatttctaagccaactctgtatttatgagagaagtttaagccttacatcatttgatactaaagggttatttgtggtaaatgaaaaatgaccccaaaattacagaggaatatgccagtttaagaaatggctacttaaagttgcttctctctttccttcttactcatgaaattaattggtcttcttcaagtttctttagattccattaaatgattaaatcactattaagagccattcatcaacgtgatttgtgtgttagccaatgaatctgtctcagcttttgaccaaatgggttttagacaaatgcaaagatctgcctctagtccatatggctctttttgagtgctagtattttgcatttcacataatgtagttattttgagcttttaaagagagcatttagacaaagaagcaaagagaggaagggaccaatcaactcatcagttccatgcatcaacaaagcatagctagtagaggaatataaatgacagattgacaaactgtaggaaacactgttactctctttctgaagttttcaagcaccatcctatgtgaaagttccctcctgtccaaacaagctcaaggcccatcttctccctatacaaggcaaacctgtaaggccttccttccaaagagtacattgctttggttttcttcctaaattcctattggaattagaactctcagaatccctgggagacagagcaaagatgacttaattcattgagcagcagagctccctataagtgaacatcaccttccccatctttcctactgccacacccatacgagagaggatctagaaagagcgatggcagcctgaacacagaaaacacccccacttggcagacctctcctcagcaatccccccagcctcatgcttcacttgcaaagtgtgacataaccacgggacgagtgccttgcttgaaccaaagcaacgatttagccagtctggacctctctgtgctttttttaattcttcctgtgaatacctcagcttcaactgggcctccatacagtcagttggtgggcttattgtactgtggtgctttgcaatgcaaccctgcaaagaacaagatttgtactaataccaaaggttctttctctatgtctcctcctctgcctccctcgttcttcccttttttctagttcttcacggttccaaagctttactatgaacctgggcatgttggcaatgcagaccgcgcaattccttaccgaattttctcagatatacctcatagacaatagtgtttagagtaatgttattatagcgtatgtaataaattattcactgtttcttttggtaactgtgattt

SEQ ID NO: 138 - protein, 976 aa, Homo sapiens
MELQAARACFALLWGCALAAAAAAQGKEVVLLDFAAAGGELGWLTHPYGKGWDLMQNIMNDMPIYMYSVCNVMSGDQDNWLRTNWVYRGEAERNNFELNFTVRDCNSFPGGASSCKETFNLYYAESDLDYGTNFQKRLFTKIDTIAPDEITVSSDFEARHVKLNVEERSVGPLTRKGFYLAFQDIGACVALLSVRVYYKKCPELLQGLAHFPETIAGSDAPSLATVAGTCVDHAVVPPGGEEPRMHCAVDGEWLVPIGQCLCQAGYEKVEDACQACSPGFFKFEASESPCLECPEHTLPSPEGATSCECEEGFFRAPQDPASMPCTRPPSAPHYLTAVGMGAKVELRWTPPQDSGGREDIVYSVTCEQCWPESGECGPCEASVRYSEPPHGLTRTSVTVSDLEPHMNYTFTVEARNGVSGLVTSRSFRTASVSINQTEPPKVRLEGRSTTSLSVSWSIPPPQQSRVWKYEVTYRKKGDSNSYNVRRTEGFSVTLDDLAPDTTYLVQVQALTQEGQGAGSKVHEFQTLSPEGSGNLAVIGGVAVGVVLLLVLAGVGFFIHRRRKNQRARQSPEDVYFSKSEQLKPLKTYVDPHTYEDPNQAVLKFTTEIHPSCVTRQKVIGAGEFGEVYKGMLKTSSGKKEVPVAIKTLKAGYTEKQRVDFLGEAGIMGQFSHHNIIRLEGVISKYKPMMIITEYMENGALDKFLREKDGEFSVLQLVGMLRGIAAGMKYLANMNYVHRDLAARNILVNSNLVCKVSDFGLSRVLEDDPEATYTTSGGKIPIRWTAPEAISYRKFTSASDVWSFGIVMWEVMTYGERPYWELSNHEVMKAINDGFRLPTPMDCPSAIYQLMMQCWQQERARRPKFADIVSILDKLIRAPDSLKTLADFDPRVSIRLPSTSGSEGVPFRTVSEWLESIKMQQYTEHFMAAGYTAIEKVVQMTNDDIKRIGVRLPGHQKRIAYSLLGLKDQVNTVGIPI

SEQ ID NO: 139 - protein, 1055 aa, Homo sapiens
MALRRLGAALLLLPLLAAVEETLMDSTTATAELGWMVHPPSGWEEVSGYDENMNTIRTYQVCNVFESSQNNWLRTKFIRRRGAHRIHVEMKFSVRDCSSIPSVPGSCKETFNLYYYEADFDSATKTFPNWMENPWVKVDTIAADESFSQVDLGGRVMKINTEVRSFGPVSRSGFYLAFQDYGGCMSLIAVRVFYRKCPRIIQNGAIFQETLSGAESTSLVAARGSCIANAEEVDVPIKLYCNGDGEWLVPIGRCMCKAGFEAVENGTVCRGCPSGTFKANQGDEACTHCPINSRTTSEGATNCVCRNGYYRADLDPLDMPCTTIPSAPQAVISSVNETSLMLEWTPPRDSGGREDLVYNIICKSCGSGRGACTRCGDNVQYAPRQLGLTEPRIYISDLLAHTQYTFEIQAVNGVTDQSPFSPQFASVNITTNQAAPSAVSIMHQVSRTVDSITLSWSQPDQPNGVILDYELQYYEKELSEYNATAIKSPTNTVTVQGLKAGAIYVFQVRARTVAGYGRYSGKMYFQTMTEAEYQTSIQEKLPLIIGSSAAGLVFLIAVVVIAIVCNRRGFERADSEYTDKLQHYTSGHMTPGMKIYIDPFTYEDPNEAVREFAKEIDISCVKIEQVIGAGEFGEVCSGHLKLPGKREIFVAIKTLKSGYTEKQRRDFLSEASIMGQFDHPNVIHLEGVVTKSTPVMIITEFMENGSLDSFLRQNDGQFTVIQLVGMLRGIAAGMKYLADMNYVHRDLAARNILVNSNLVCKVSDFGLSRFLEDDTSDPTYTSALGGKIPIRWTAPEAIQYRKFTSASDVWSYGIVMWEVMSYGERPYWDMTNQDVINAIEQDYRLPPPMDCPSALHQLMLDCWQKDRNHRPKFGQIVNTLDKMIRNPNSLKAMAPLSSGINLPLLDRTIPDYTSFNTVDEWLEAIKMGQYKESFANAGFTSFDVVSQMMMEDILRVGVTLAGHQKKILNSIQVMRAQMNQIQSVEGQPLARRPRATGRTKRCQPRDVTKKTCNSNDGKKKGMGKKKTDPGRGREIQGIFFKEDSHKESNDCSCGG

SEQ ID NO: 140 - protein, 178 aa, Homo sapiens
MSGGKYVDSEGHLYTVPIREQGNIYKPNNKAMADELSEKQVYDAHTKEIDLVNRDPKHLNDDVVKIDFEDVIAEPEGTHSFDGIWKASFTTFTVTKYWFYRLLSALFGIPMALIWGIYFAILSFLHIWAVVPCIKSFLIEIQCISRVYSIYVHTVCDPLFEAVGKIFSNVRINLQKEI

SEQ ID NO: 141 - protein, 162 aa, Homo sapiens
MGLETEKADVQLFMDDDSYSHHSGLEYADPEKFADSDQDRDPHRLNSHLKLGFEDVIAEPVTTHSFDKVWICSHALFEISKYVMYKFLTVFLAIPLAFIAGILFATLSCLHIWILMPFVKTCLMVLPSVQTIWKSVTDVIIAPLCTSVGRCFSSVSLQLSQD

SEQ ID NO: 142 - protein, 346 aa, Homo sapiens
MAMVSEFLKQAWFIENEEQEYVQTVKSSKGGPGSAVSPYPTFNPSSDVAALHKAIMVKGVDEATIIDILTKRNNAQRQQIKAAYLQETGKPLDETLKKALTGHLEEVVLALLKTPAQFDADELRAAMKGLGTDEDTLIEILASRTNKEIRDINRVYREELKRDLAKDITSDTSGDFRNALLSLAKGDRSEDFGVNEDLADSDARALYEAGERRKGTDVNVFNTILTTRSYPQLRRVFQKYTKYSKHDMNKVLDLELKGDIEKCLTAIVKCATSKPAFFAEKLHQAMKGVGTRHKALIRIMVSRSEIDMNDIKAFYQKMYGISLCQAILDETKGDYEKILVALCGGN

SEQ ID NO: 143 - protein, 339 aa, Homo sapiens
MSTVHEILCKLSLEGDHSTPPSAYGSVKAYTNFDAERDALNIETAIKTKGVDEVTIVNILTNRSNAQRQDIAFAYQRRTKKELASALKSALSGHLETVILGLLKTPAQYDASELKASMKGLGTDEDSLIEIICSRTNQELQEINRVYKEMYKTDLEKDIISDTSGDFRKLMVALAKGRRAEDGSVIDYELIDQDARDLYDAGVKRKGTDVPKWISIMTERSVPHLQKVFDRYKSYSPYDMLESIRKEVKGDLENAFLNLVQCIQNKPLYFADRLYDSMKGKGTRDKVLIRIMVSRSEVDMLKIRSEFKRKYGKSLYYYIQQDTKGDYQKALLYLCGGDD

SEQ ID NO: 144 - protein, 372 aa, Homo sapiens
MATSPQKSPSVPKSPTPKSPPSRKKDDSFLGKLGGTLARRKKAKEVSELQEEGMNAINLPLSPIPFELDPEDTMLEENEVRTMVDPNSRSDPKLQELMKVLIDWINDVLVGERIIVKDLAEDLYDGQVLQKLFEKLESEKLNVAEVTQSEIAQKQKLQTVLEKINETLKLPPRSIKWNVDSVHAKSLVAILHLLVALSQYFRAPIRLPDHVSIQVVVVQKREGILQSRQIQEEITGNTEALSGRHERDAFDTLFDHAPDKLNVVKKTLITFVNKHLNKLNLEVTELETQFADGVYLVLLMGLLEGYFVPLHSFFLTPDSFEQKVLNVSFAFELMQDGGLEKPKPRPEDIVNCDLKSTLRVLYNLFTKYRNVE

SEQ ID NO: 145 - protein, 397 aa, Homo sapiens
MRSPSAAWLLGAAILLAASLSCSGTIQGTSRSSKGRSLIGKVDGTSHVTGKGVTVETVFSVDEFSASVLTGKLTTVFLPIVYTIVFVVGLPSNGMALWVFLFRTKKKHPAVIYMANLALADLLSVIWFPLKIAYHIHGNNWIYGEALCNVLIGFFYGNMYCSILFMTCLSVQRYWVIVNPMGHSRKKANIAIGISLAIWLLILLVTIPLYVVKQTIFIPALNITTCHDVLPEQLLVGDMFNYFLSLAIGVFLFPAFLTASAYVLMIRMLRSSAMDENSEKKRKRAIKLIVTVLAMYLICFTPSNLLLVVHYFLIKSQGQSHVYALYIVALCLSTLNSCIDPFVYYFVSHDFRDHAKNALLCRSVRTVKQMQVSLTSKKHSRKSSSYSSSSTTVKTSY

SEQ ID NO: 146 - protein, 295 aa, Homo sapiens
METPAWPRVPRPETAVARTLLLGWVFAQVAGASGTTNTVAAYNLTWKSTNFKTILEWEPKPVNQVYTVQISTKSGDWKSKCFYTTDTECDLTDEIVKDVKQTYLARVFSYPAGNVESTGSAGEPLYENSPEFTPYLETNLGQPTIQSFEQVGTKVNVTVEDERTLVRRNNTFLSLRDVFGKDLIYTLYYWKSSSSGKKTAKTNTNEFLIDVDKGENYCFSVQAVIPSRTVNRKSTDSPVECMGQEKGEFREIFYIIGAVVFVVIILVIILAISLHKCRKAGVGQSWKENSPLNVS

SEQ ID NO: 147 - protein, 491 aa, Homo sapiens
MAQSGGEARPGPKTAVQIRVAIQEAEDVDELEDEEEGAETRGAGDPARYLSPGWGSASEEEPSRGHSGTTASGGENEREDLEQEWKPPDEELIKKLVDQIEFCFSDENLEKDAFLLKHVRRNKLGYVSVKLLTSFKKVKHLTRDWRTTAHALKYSVVLELNEDHRKVRRTTPVPLFPNENLPSKMLLVYDLYLSPKLWALATPQKNGRVQEKVMEHLLKLFGTFGVISSVRILKPGRELPPDIRRISSRYSQVGTQECAIVEFEEVEAAIKAHEFMITESQGKENMKAVLIGMKPPKKKPAKDKNHDEEPTASIHLNKSLNKRVEELQYMGDESSANSSSDPESNPTSPMAGRRHAATNKLSPSGHQNLFLSPNASPCTSPWSSPLAQRKGVSRKSPLAEEGRLNCSTSPEIFRKCMDYSSDSSVTPSGSPWVRRRRQAEMGTQEKSPGTSPLLSRKMQTADGLPVGVLRLPRGPDNTRGFHGHERSRACV

SEQ ID NO: 148 - protein, 374 aa, Homo sapiens
MRPGTALQAVLLAVLLVGLRAATGRLLSGQPVCRGGTQRPCYKVIYFHDTSRRLNFEEAKEACRRDGGQLVSIESEDEQKLIEKFIENLLPSDGDFWIGLRRREEKQSNSTACQDLYAWTDGSISQFRNWYVDEPSCGSEVCVVMYHQPSAPAGIGGPYMFQWNDDRCNMKNNFICKYSDEKPAVPSREAEGEETELTTPVLPEETQEEDAKKTFKESREAALNLAYILIPSIPLLLLLVVTTVVCWVWICRKRKREQPDPSTKKQHTIWPSPHQGNSPDLEVYNVIRKQSEADLAETRPDLKNISFRVCSGEATPDDMSCDYDNMAVNPSESGFVTLVSVESGFVTNDIYEFSPDQMGRSKESGWVENEIYGY

SEQ ID NO: 149 - protein, 276 aa, Homo sapiens
MALLDVCGAPRGQRPESALPVAGSGRRSDPGHYSFSMRSPELALPRGMKPTEFFQSLGGDGERNVQIEMAHGTTTLAFKFQHGVIAAVDSRASAGSYISALRVNKVIEINPYLLGTMSGCAADCQYWERLLAKECRLYYLRNGERISVSAASKLLSNMMCQYRGMGLSMGSMICGWDKKGPGLYYVDEHGTRLSGNMFSTGSGNTYAYGVMDSGYRPNLSPEEAYDLGRRAIAYATHRDSYSGGVVNMYHMKEDGWVKVESTDVSDLLHQYREANQ

SEQ ID NO: 150 - protein, 219 aa, Homo sapiens
MLRAGAPTGDLPRAGEVHTGTTIMAVEFDGGVVMGSDSRVSAGEAVVNRVFDKLSPLHERIYCALSGSAADAQAVADMAAYQLELHGIELEEPPLVLAAANVVRNISYKYREDLSAHLMVAGWDQREGGQVYGTLGGMLTRQPFAIGGSGSTFIYGYVDAAYKPGMSPEECRRFTTDAIALAMSRDGSSGGVIYLVTITAAGVDHRVILGNELPKFYDE

SEQ ID NO: 151 - protein, 253 aa, Homo sapiens
MANLGCWMLVLFVATWSDLGLCKKRPKPGGWNTGGSRYPGQGSPGGNRYPPQGGGGWGQPHGGGWGQPHGGGWGQPHGGGWGQPHGGGWGQGGGTHSQWNKPSKPKTNMKHMAGAAAAGAVVGGLGGYMLGSAMSRPIIHFGSDYEDRYYRENMHRYPNQVYYRPMDEYSNQNNFVHDCVNITIKQHTVTTTTKGENFTETDVKMMERVVEQMCITQYERESQAYYQRGSSMVLFSSPPVILLISFLIFLIVG

SEQ ID NO: 152 - protein, 323 aa, Homo sapiens
MDSKQQCVKLNDGHFMPVLGFGTYAPPEVPRSKALEVSKLAIEAGFRHIDSAHLYNNEEQVGLAIRSKIADGSVKREDIFYTSKLWSTSHRPELVRPALENSLKKAQLDYVDLYLIHSPMSLKPGEELSPTDENGKVIFDIVDLCTTWEAMEKCKDAGLAKSIGVSNFNRRQLEMILNKPGLKYKPVCNQVECHPYFNRSKLLDFCKSKDIVLVAYSALGSQRDKRWVDPNSPVLLEDPVLCALAKKHKRTPALIALRYQLQRGVVVLARSYNEQRIRQNVQVFEFQLTAEDMKAIDGLDRNLHYFNSDSFASHPNYPYSDEY

SEQ ID NO: 153 - protein, 784 aa, Homo sapiens
MEGDGGTPWALALLRTFDAGEFTGWEKVGSGGFGQVYKVRHVHWKTWLAIKCSPSLHVDDRERMELLEEAKKMEMAKFRYILPVYGICREPVGLVMEYMETGSLEKLLASEPLPWDLRFRIIHETAVGMNFLHCMAPPLLHLDLKPANILLDAHYHVKISDFGLAKCNGLSHSHDLSMDGLFGTIAYLPPERIREKSRLFDTKHDVYSFAIVIWGVLTQKKPFADEKNILHIMVKVVKGHRPELPPVCRARPRACSHLIRLMQRCWQGDPRVRPTFQEITSETEDLCEKPDDEVKETAHDLDVKSPPEPRSEVVPARLKRASAPTFDNDYSLSELLSQLDSGVSQAVEGPEELSRSSSESKLPSSGSGKRLSGVSSVDSAFSSRGSLSLSFEREPSTSDLGTTDVQKKKLVDAIVSGDTSKLMKILQPQDVDLALDSGASLLHLAVEAGQEECAKWLLLNNANPNLSNRRGSTPLHMAVERRVRGVVELLLARKISVNAKDEDQWTALHFAAQNGDESSTRLLLEKNASVNEVDFEGRTPMHVACQHGQENIVRILLRRGVDVSLQGKDAWLPLHYAAWQGHLPIVKLLAKQPGVSVNAQTLDGRTPLHLAAQRGHYRVARILIDLCSDVNVCSLLAQTPLHVAAETGHTSTARLLLHRGAGKKAVTSDGYTALHLAARNGHLATVKLLVEEKADVLARGPLNQTALHLAAAHGHSEVVEELVSADVIDLFDEQGLSALHLAAQGRHAQTVETLLRHGAHINLQSLKFQGGHGPAATLLRRSKT

SEQ ID NO: 154 - protein, 682 aa, Homo sapiens
MGKKYKNIVLLKGLEVINDYHFRMVKSLLSNDLKLNLKMREEYDKIQIADLMEEKFRGDAGLGKLIKIFEDIPTLEDLAETLKKEKLKVKGPALSRKRKKEVHATSPAPSTSSTVKTEGAEATPGAQKRKKSTKEKAGPKGSKVSEEQTQPPSPAGAGMSTAMGRSPSPKTSLSAPPNSSSTENPKTVAKCQVTPRRNVLQKRPVIVKVLSTTKPFEYETPEMEKKIMFHATVATQTQFFHVKVLNTSLKEKFNGKKIIIISDYLEYDSLLEVNEESTVSEAGPNQTFEVPNKIINRAKETLKIDILHKQASGNIVYGVFMLHKKTVNQKTTIYEIQDDRGKMDVVGTGQCHNIPCEEGDKLQLFCFRLRKKNQMSKLISEMHSFIQIKKKTNPRNNDPKSMKLPQEQRQLPYPSEASTTFPESHLRTPQMPPTTPSSSFFTKKSEDTISKMNDFMRMQILKEGSHFPGPFMTSIGPAESHPHTPQMPPSTPSSSFLTTLKPRLKTEPEEVSIEDSAQSDLKEVMVLNATESFVYEPKEQKKMFHATVATENEVFRVKVFNIDLKEKFTPKKIIAIANYVCRNGFLEVYPFTLVADVNADRNMEIPKGLIRSASVTPKINQLCSQTKGSFVNGVFEVHKVSPHHCFIKFLLQPPIFKVLTCQLEFGQLTQHRKSTPSPFPQH

SEQ ID NO: 155 - protein, 1218 aa, Homo sapiens
MRSPRTRGRSGRPLSLLLALLCALRAKVCGASGQFELEILSMQNVNGELQNGNCCGGARNPGDRKCTRDECDTYFKVCLKEYQSRVTAGGPCSFGSGSTPVIGGNTFNLKASRGNDRNRIVLPFSFAWPRSYTLLVEAWDSSNDTVQPDSIIEKASHSGMINPSRQWQTLKQNTGVAHFEYQIRVTCDDYYYGFGCNKFCRPRDDFFGHYACDQNGNKTCMEGWMGPECNRAICRQGCSPKHGSCKLPGDCRCQYGWQGLYCDKCIPHPGCVHGICNEPWQCLCETNWGGQLCDKDLNYCGTHQPCLNGGTCSNTGPDKYQCSCPEGYSGPNCEIAEHACLSDPCHNRGSCKETSLGFECECSPGWTGPTCSTNIDDCSPNNCSHGGTCQDLVNGFKCVCPPQWTGKTCQLDANECEAKPCVNAKSCKNLIASYYCDCLPGWMGQNCDININDCLGQCQNDASCRDLVNGYRCICPPGYAGDHCERDIDECASNPCLNGGHCQNEINRFQCLCPTGFSGNLCQLDIDYCEPNPCQNGAQCYNRASDYFCKCPEDYEGKNCSHLKDHCRTTPCEVIDSCTVAMASNDTPEGVRYISSNVCGPHGKCKSQSGGKFTCDCNKGFTGTYCHENINDCESNPCRNGGTCIDGVNSYKCICSDGWEGAYCETNINDCSQNPCHNGGTCRDLVNDFYCDCKNGWKGKTCHSRDSQCDEATCNNGGTCYDEGDAFKCMCPGGWEGTTCNIARNSSCLPNPCHNGGTCVVNGESFTCVCKEGWEGPICAQNTNDCSPHPCYNSGTCVDGDNWYRCECAPGFAGPDCRININECQSSPCAFGATCVDEINGYRCVCPPGHSGAKCQEVSGRPCITMGSVIPDGAKWDDDCNTCQCLNGRIACSKVWCGPRPCLLHKGHSECPSGQSCIPILDDQCFVHPCTGVGECRSSSLQPVKTKCTSDSYYQDNCANITFTFNKEMMSPGLTTEHICSELRNLNILKNVSAEYSIYIACEPSPSANNEIHVAISAEDIRDDGNPIKEITDKIIDLVSKRDGNSSLIAAVAEVRVQRRPLKNRTDFLVPLLSSVLTVAWICCLVTAFYWCLRKRRKPGSHTHSASEDNTTNNVREQLNQIKNPIEKHGANTVPIKDYENKNSKMSKIRTHNSEVEEDDMDKHQQKARFAKQPAYTLVDREEKPPNGTPTKHPNWTNKQDNRDLESAQSLNRMEYIV

SEQ ID NO: 156 - protein, 334 aa, Homo sapiens [sequence omitted]

SEQ ID NO: 157 - protein, 584 aa, Homo sapiens
MKMASSLAFLLLNFHVSLFLVQLLTPCSAQFSVLGPSGPILAMVGEDADLPCHLFPTMSAETMELRWVSSSLRQVVNVYADGKEVEDRQSAPYRGRTSILRDGITAGKAALRIHNVTASDSGKYLCYFQDGDFYEKALVELKVAALGSDLHIEVKGYEDGGIHLECRSTGWYPQPQIKWSDTKGENIPAVEAPVVADGVGLYAVAASVIMRGSSGGGVSCIIRNSLLGLEKTASISIADPFFRSAQPWIAALAGTLPISLLLLAGASYFLWRQQKEKIALSRETEREREMKEMGYAATEQEISLREKLQEELKWRKIQYMARGEKSLAYHEWKMALFKPADVILDPDTANAILLVSEDQRSVQRAEEPRDLPDNPERFEWRYCVLGCENFTSGRHYWEVEVGDRKEWHIGVCSKNVERKKGWVKMTPENGYWTMGLTDGNKYRALTEPRTNLKLPEPPRKVGIFLDYETGEISFYNATDGSHIYTFPHASFSEPLYPVFRILTLEPTALTICPIPKEVESSPDPDLVPDHSLETPLTPGLANESGEPQAEVTSLLLPAHPGAEVSPSATTNQNHKLQARTEALY

SEQ ID NO: 158 - protein, 708 aa, Homo sapiens
MNPTETKAIPVSQQMEGPHLPNKKKHKKQAVKTEPEKKSQSTKLSVVHEKKSQEGKPKEHTEPKSLPKQASDTGSNDAHNKKAVSRSAEQQPSEKSTEPKTKPQDMISAGGESVAGITAISGKPGDKKKEKKSLTPAVPVESKPDKPSGKSGMDAALDDLIDTLGGPEETEEENTTYTGPEVSDPMSSTYIEELGKREVTIPPKYRELLAKKEGITGPPADSSKPIGPDDAIDALSSDFTCGSPTAAGKKTEKEESTEVLKAQSAGTVRSAAPPQEKKRKVEKDTMSDQALEALSASLGTRQAEPELDLRSIKEVDEAKAKEEKLEKCGEDDETIPSEYRLKPATDKDGKPLLPEPEEKPKPRSESELIDELSEDFDRSECKEKPSKPTEKTEESKAAAPAPVSEAVCRTSMCSIQSAPPEPATLKGTVPDDAVEALADSLGKKEADPEDGKPVMDKVKEKAKEEDREKLGEKEETIPPDYRLEEVKDKDGKPLLPKESKEQLPPMSEDFLLDALSEDFSGPQNASSLKFEDAKLAAAISEVVSQTPASTTQAGAPPRDTSQSDKDLDDALDKLSDSLGQRQPDPDENKPMEDKVKEKAKAEHRDKLGERDDTIPPEYRHLLDDNGQDKPVKPPTKKSEDSKKPADDQDPIDALSGDLDSCPSTTETSQNTAKDKCKKAASSSKAPKNGGKAKDSAKTTEETSKPKDD

SEQ ID NO: 159 - protein, 395 aa, Homo sapiens
MWLPRVSSTAVTALLLAQTFLLLFLVSRPGPSSPAGGEARVHVLVLSSWRSGSSFVGQLFNQHPDVFYLMEPAWHVWTTLSQGSAATLHMAVRDLVRSVFLCDMDVFDAYLPWRRNLSDLFQWAVSRALCSPPACSAFPRGAISSEAVCKPLCARQSFTLAREACRSYSHVVLKEVRFFNLQVLYPLLSDPALNLRIVHLVRDPRAVLRSREQTAKALARDNGIVLGTNGTWVEADPGLRVVREVCRSHVRIAEAATLKPPPFLRGRYRLVRFEDLAREPLAEIRALYAFTGLSLTPQLEAWIHNITHGSGPGARREAFKTSSRNALNVSQAWRHALPFAKIRRVQELCAGALQLLGYRPVYSEDEQRNLALDLVLPRGLNGFTWASSTASHPRN

SEQ ID NO: 160 - protein, 254 aa, Homo sapiens
MPAKTPIYLKAANNKKGKKFKLRDILSPDMISPPLGDFRHTIHIGKEGQHDVFGDISFLQGNYELLPGNQEKAHLGQFPGHNEFFRANSTSDSVFTETPSPVLKNAISLPTIGGSQALMLPLLSPVTFNSKQESFGPAKLPRLSCEPVMEEKAQEKSSLLENGTVHQGDTSWGSSGSASQSSQGRDSHSSSLSEQYPDWPAEDMFDHPTPCELIKGKTKSEESLSDLTGSLLSLQLDLGPSLLDEVLNVMDKNK

SEQ ID NO: 161 - protein, 536 aa, Homo sapiens
MDKVGKMWNNFKYRCQNLFGHEGGSRSENVDMNSNRCLSVKEKNISIGDSTPQQQSSPLRENIALQLGLSPSKNSSRRNQNCATEIPQIVEISIEKDNDSCVTPGTRLARRDSYSRHAPWGGKKKHSCSTKTQSSLDADKKFGRTRSGLQRRERRYGVSSVHDMDSVSSRTVGSRSLRQRLQDTVGLCFPMRTYSKQSKPLFSNKRKIHLSELMLEKCPFPAGSDLAQKWHLIKQHTAPVSPHSTFFDTFDPSLVSTEDEEDRLRERRRLSIEEGVDPPPNAQIHTFEATAQVNPLYKLGPKLAPGMTEISGDSSAIPQANCDSEEDTTTLCLQSRRQKQRQISGDSHTHVSRQGAWKVHTQIDYIHCLVPDLLQITGNPCYWGVMDRYEAEALLEGKPEGTFLLRDSAQEDYLFSVSFRRYNRSLHARIEQWNHNFSFDAHDPCVFHSSTVTGLLEHYKDPSSCMFFEPLLTISLNRTFPFSLQYICRAVICRCTTYDGIDGLPLPSMLQDFLKEYHYKQKVRVRWLEREPVKAK

SEQ ID NO: 162 - protein, 142 aa, Homo sapiens
MATKIDKEACRAAYNLVRDDGSAVIWVTFKYDGSTIVPGEQGAEYQHFIQQCTDDVRLFAFVRFTTGDAMSKRSKFALITWIGENVSGLQRAKTGTDKTLVKEVVQNFAKEFVISDRKELEEDFIKSELKKAGGANYDAQTE

SEQ ID NO: 163 - protein, 658 aa, Homo sapiens
MAEAAAAAGGTGLGAGASYGSAADRDRDPDPDRAGRRLRVLSGHLLGRPREALSTNECKARRAASAATAAPTATPAAQESGTIPKKRQEVMKWNGWGYNDSKFIFNKKGQIELTGKRYPLSGMGLPTFKEWIQNTLGVNVEHKTTSKASLNPSDTPPSVVNEDFLHDLKETNISYSQEADDRVFRAHGHCLHEIFLLREGMFERIPDIVLWPTCHDDVVKIVNLACKYNLCIIPIGGGTSVSYGLMCPADETRTIISLDTSQMNRILWVDENNLTAHVEAGITGQELERQLKESGYCTGHEPDSLEFSTVGGWVSTRASGMKKNIYGNIEDLVVHIKMVTPRGIIEKSCQGPRMSTGPDIHHFIMGSEGTLGVITEATIKIRPVPEYQKYGSVAFPNFEQGVACLREIAKQRCAPASIRLMDNKQFQFGHALKPQVSSIFTSFLDGLKKFYITKFKGFDPNQLSVATLLFEGDREKVLQHEKQVYDIAAKFGGLAAGEDNGQRGYLLTYVIAYIRDLALEYYVLGESFETSAPWDRVVDLCRNVKERITRECKEKGVQFAPFSTCRVTQTYDAGACIYFYFAFNYRGISDPLTVFEQTEAAAREEILANGGSLSHHHGVGKLRKQWLKESISDVGFGMLKSVKEYVDPNNIFGNRNLL

SEQ ID NO: 164 - protein, 482 aa, Homo sapiens
MPPSPLDDRVVVALSRPVRPQDLNLCLDSSYLGSANPGSNSHPPVIATTVVSLKAANLTYMPSSSGSARSLNCGCSSASCCTVATYDKDNQAQTQAIAAGTTTTAIGTSTTCPANQMVNNNENTGSLSPSSGVGSPVSGTPKQLASIKIIYPNDLAKKMTKCSKSHLPSQGPVIIDCRPFMEYNKSHIQGAVHINCADKISRRRLQQGKITVLDLISCREGKDSFKRIFSKEIIVYDENTNEPSRVMPSQPLHIVLESLKREGKEPLVLKGGLSSFKQNHENLCDNSLQLQECREVGGGASAASSLLPQPIPTTPDIENAELTPILPFLFLGNEQDAQDLDTMQRLNIGYVINVTTHLPLYHYEKGLFNYKRLPATDSNKQNLRQYFEEAFEFIEEAHQCGKGLLIHCQAGVSRSATIVIAYLMKHTRMTMTDAYKFVKGKRPIISPNLNFMGQLLEFEEDLNNGVTPRILTPKLMGVETVV

SEQ ID NO: 165 - protein, 407 aa, Homo sapiens
MESAITLWQFLLQLLLDQKHEHLICWTSNDGEFKLLKAEEVAKLWGLRKNKTNMNYDKLSRALRYYYDKNIIKKVIGQKFVYKFVSFPEILKMDPHAVEISRESLLLQDSDCKVSPEGREAHKHGLAVLRSTSRNEYIHSGLYSSFTINSLENPPDAFKAIKREKLEEPPEDSPPVEEVRTVIRFVTNKTDKHVTRPVVSLPSTSEAAAASAFLASSVSAKISSLMLPNAASISSASPFSSRSPSLSPKSPLPSEHRSLFLEAACHDSDSLEPLNLSSGSKTKSPSLPPKAKKPKGLEISAPPLVLSGTDIGSIALNSPALPSGSLTPAFFTAQTPNGLLLTPSPLLSSIHFWSSLSPVAPLSPARLQGPSTLFQFPTLLNGHMPVPIPSLDRAASPVLLSSNSQKS

SEQ ID NO: 166 - protein, 364 aa, Homo sapiens
MAAISTSIPVISQPQFTAMNEPQCFYNESIAFFYNRSGKHLATEWNTVSKLVMGLGITVCIFIMLANLLVMVAIYVNRRFHFPIYYLMANLAAADFFAGLAYFYLMFNTGPNTRRLTVSTWLLRQGLIDTSLTASVANLLAIAIERHITVFRMQLHTRMSNRRVVVVIVVIWTMAIVMGAIPSVGWNCICDIENCSNMAPLYSDSYLVFWAIFNLVTFVVMVVLYAHIFGYVRQRTMRMSRHSSGPRRNRDTMMSLLKTVVIVLGAFIICWTPGLVLLLLDVCCPQCDVLAYEKFFLLLAEFNSAMNPIIYSYRDKEMSATFRQILCCQRSENPTGPTEGSDRSASSLNHTILAGVHSNDHSVV

SEQ ID NO: 167 - protein, 759 aa, Homo sapiens
MESSPFNRRQWTSLSLRVTAKELSLVNKNKSSAIVEIFSKYQKAAEETNMEKKRSNTENLSQHFRKGTLTVLKKKWENPGLGAESHTDSLRNSSTEIRHRADHPPAEVTSHAASGAKADQEEQIHPRSRLRSPPEALVQGRYPHIKDGEDLKDHSTESKKMENCLGESRHEVEKSEISENTDASGKIEKYNVPLNRLKMMFEKGEPTQTKILRAQSRSASGRKISENSYSLDDLEIGPGQLSSSTFDSEKNESRRNLELPRLSETSIKDRMAKYQAAVSKQSSSTNYTNELKASGGEIKIHKMEQKENVPPGPEVCITHQEGEKISANENSLAVRSTPAEDDSRDSQVKSEVQQPVHPKPLSPDSRASSLSESSPPKAMKKFQAPARETCVECQKTVYPMERLLANQQVFHISCFRCSYCNNKLSLGTYASLHGRIYCKPHFNQLFKSKGNYDEGFGHRPHKDLWASKNENEEILERPAQLANARETPHSPGVEDAPIAKVGVLAASMEAKASSQQEKEDKPAETKKLRIAWPPPTELGSSGSALEEGIKMSKPKWPPEDEISKPEVPEDVDLDLKKLRRSSSLKERSRPFTVAASFQSTSVKSPKTVSPPIRKGWSMSEQSEESVGGRVAERKQVENAKASKKNGNVGKTTWQNKESKGETGKRSKEGHSLEMENENLVENGADSDEDDNSFLKQQSPQEPKSLNWSSFVDNTFAEEFTTQNQKSQDVELWEGEVVKELSVEEQIKRNRYYDEDEDEE

SEQ ID NO: 168 - protein, 695 aa, Homo sapiens
MIMKSNFDETYIENVVRNILKGQDVDSKEAQLISFLALLSSYVTDSTISVSQCEIFLGIIYTSTPWEPESLEDKMGTYSTLLIKTEVAEYGRYTGVRIIHPLIALYCLKELERSYHLDKCQIALNILEENLFYDSGIGRDKFQHDVQTLLLTRQRKVYGDETDTLFSPLMEALQNKDIEKVLSAGSRRFPQNAFICQALARHFYIKEKDFNTALDWARQAKMKAPKNSYISDTLGQVYKSEIKWWLDGNKNCRSITVNDLTHLLEAAEKASRAFKESQRQTDSKNYETENWSPQKSQRRYDMYNTACFLGEIEVGLYTIQILQLTPFFHKENELSKKHMVQFLSGKWTIPPDPRNECYLALSKFTSHLKNLQSDLKRCFDFFIDYMVLLKMRYTQKEIAEIMLSKKVSRCFRKYTELFCHLDPCLLQSKESQLLQEENCRKKLEALRADRFAGLLEYLNPNYKDATTMESIVNEYAFLLQQNSKKPMTNEKQNSILANIILSCLKPNSKLIQPLTTLKKQLREVLQFVGLSHQYPGPYFLACLLFWPENQELDQDSKLIEKYVSSLNRSFRGQYKRMCRSKQASTLFYLGKRKGLNSIVHKAKIEQYFDKAQNTNSLWHSGDVWKKNEVKDLLRRLTGQAEGKLISVEYGTEEKIKIPVISVYSGPLRSGRNIERVSFYLGFSIEGPLAYDIEVI

SEQ ID NO: 169 - protein, 746 aa, Homo sapiens
MQAKKRYFILLSAGSCLALLFYFGGLQFRASRSHSRREEHSGRNGLHHPSPDHFWPRFPEPLRPFVPWDQLENEDSSVHISPRQKRDANSSIYKGKKCRMESCFDFTLCKKNGFKVYVYPQQKGEKIAESYQNILAAIEGSRFYTSDPSQACLFVLSLDTLDRDQLSPQYVHNLRSKVQSLHLWNNGRNHLIFNLYSGTWPDYTEDVGFDIGQAMLAKASISTENFRPNFDVSIPLFSKDHPRTGGERGFLKFNTIPPLRKYMLVFKGKRYLTGIGSDTRNALYHVHNGEDVVLLTTCKHGKDWQKHKDSRCDRDNTEYEKYDYREMLHNATFCLVPRGRRLGSFRFLEALQAACVPVMLSNGWELPFSEVINWNQAAVIGDERLLLQIPSTIRSIHQDKILALRQQTQFLWEAYFSSVEKIVLTTLEIIQDRIFKHISRNSLIWNKHPGGLFVLPQYSSYLGDFPYYYANLGLKPPSKFTAVIHAVTPLVSQSQPVLKLLVAAAKSQYCAQIIVLWNCDKPLPAKHRWPATAVPVVVIEGESKVMSSRFLPYDNIITDAVLSLDEDTVLSTTEVDFAFTVWQSFPERIVGYPARSHFWDNSKERWGYTSKWTNDYSMVLTGAAIYHKYYHYLYSHYLPASLKNMVDQLANCEDILMNFLVSAVTKLPPIKVTQKKQYKETMMGQTSRASRWADPDHFAQRQSCMNTFASWFGYMPLIHSQMRLDPVLFKDQVSILRKKYRDIERL

SEQ ID NO: 170 - protein, 1069 aa, Homo sapiens [sequence omitted]

SEQ ID NO: 171 - protein, 437 aa, Homo sapiens
MSWSLHPRNLILYFYALLFLSSTCVAYVATRDNCCILDERFGSYCPTTCGIADFLSTYQTKVDKDLQSLEDILHQVENKTSEVKQLIKAIQLTYNPDESSKPNMIDAATLKSRKMLEEIMKYEASILTHDSSIRYLQEIYNSNNQKIVNLKEKVAQLEAQCQEPCKDTVQIHDITGKDCQDIANKGAKQSGLYFIKPLKANQQFLVYCEIDGSGNGWTVFQKRLDGSVDFKKNWIQYKEGFGHLSPTGTTEFWLGNEKIHLISTQSAIPYALRVELEDWNGRTSTADYAMFKVGPEADKYRLTYAYFAGGDAGDAFDGFDFGDDPSDKFFTSHNGMQFSTWDNDNDKFEGNCAEQDGSGWWMNKCHAGHLNGVYYQGGTYSKASTPNGYDNGIIWATWKTRWYSMKKTTMKIIPFNRLTIGEGQQHHLGGAKQAGDV

SEQ ID NO: 172 - protein, 642 aa, Homo sapiens
MKRSSVSSGGAGRLSMQELRSQDVNKQGLYTPQTKEKPTFGKLSINKPTSERKVSLFGKRTSGHGSRNSQLGIFSSSEKIKDPRPLNDKAFIQQCIRQLCEFLTENGYAHNVSMKSLQAPSVKDFLKIFTFLYGFLCPSYELPDTKFEEEVPRIFKDLGYPFALSKSSMYTVGAPHTWPHIVAALVWLIDCIKIHTAMKESSPLFDDGQPWGEETEDGIMHNKLFLDYTIKCYESFMSGADSFDEMNAELQSKLKDLFNVDAFKLESLEAKNRALNEQIARLEQEREKEPNRLESLRKLKASLQGDVQKYQAYMSNLESHSAILDQKLNGLNEEIARVELECETIKQENTRLQNIIDNQKYSVADIERINHERNELQQTINKLTKDLEAEQQKLWNEELKYARGKEAIETQLAEYHKLARKLKLIPKGAENSKGYDFEIKFNPEAGANCLVKYRAQVYVPLKELLNETEEEINKALNKKMGLEDTLEQLNAMITESKRSVRTLKEEVQKLDDLYQQKIKEAEEEDEKCASELESLEKHKHLLESTVNQGLSEAMNELDAVQREYQLVVQTTTEERRKVGNNLQRLLEMVATHVGSVEKHLEEQIAKVDREYEECMSEDLSENIKEIRDKYEKKATLIKSSEE

SEQ ID NO: 173 - protein, 178 aa, Homo sapiens [sequence omitted]

SEQ ID NO: 174 - protein, 237 aa, Homo sapiens
MLGGSLGSRLLRGVGGSHGRFGARGVREGGAAMAAGESMAQRMVWVDLEMTGLDIEKDQIIEMACLITDSDLNILAEGPNLIIKQPDELLDSMSDWCKEHHGRSGLTKAVKESTITLQQAEYEFLSFVRQQTPPGLCPLAGNSVHEDKKFLDKYMPQFMKHLHYRIIDVSTVKELCRRWYPEEYEFAPKKAASHRALDDISESIKELQFYRNNIFKKKIDEKKRKIIENGENEKTVS

SEQ ID NO: 175 - protein, 390 aa, Homo sapiens
MGQRLSGGRSCLDVPGRLLPQPPPPPPPVRRKLALLFAMLCVWLYMFLYSCAGSCAAAPGLLLLGSGSRAAHDPPALATAPDGTPPRLPFRAPPATPLASGKEMAEGAASPEEQSPEVPDSPSPISSFFSGSGSKQLPQAIIIGVKKGGTRALLEFLRVHPDVRAVGAEPHFFDRSYDKGLAWYRDLMPRTLDGQITMEKTPSYFVTREAPARISAMSKDTKLIVVVRDPVTRAISDYTQTLSKRPDIPTFESLTFKNRTAGLIDTSWSAIQIGIYAKHLEHWLRHFPIRQMLFVSGERLISDPAGELGRVQDFLGLKRIITDKHFYFNKTKGFPCLKKAEGSSRPHCLGKTKGRTHPEIDREVVRRLREFYRPFNLKFYQMTGHDFGWD

SEQ ID NO: 176 - protein, 742 aa, Homo sapiens
MDKFWWHAAWGLCLVPLSLAQIDLNITCRFAGVFHVEKNGRYSISRTEAADLCKAFNSTLPTMAQMEKALSIGFETCRYGFIEGHVVIPRIHPNSICAANNTGVYILTYNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATTLMSTSATATETATKRQEAWDWFSWLFLPSESKNHLHTTTQMAGTSSNTISAGWEPNEENEDERDRHLSFSGSGIDDDEDFISSTISTTPRAFDHTKQNQDWTQWNPSHSNPEVLLQTTTRMTDVDRNGTTAYEGNWNPEAHPPLIHHEHHEEEETPHSTSTIQATPSSTTEETATQKEQWFGNRWHEGYRQTPREDSHSTTGTAAASAHTSHPMQGRTTPSPEDSSWTDFFNPISHPMGRGHQAGRRMDMDSSHSTTLQPTANPNTGLVENLDRTGPLSMTTQQSNSQSFSTSHEGLEEDKDHPTTSTLTSSNRNDVTGGRRDPNHSEGSTTLLEGYTSHYPHTKESRTFIPVTSAKTGSFGVTAVTVGDSNSNVNRSLSGDQDTFHPSGGSHTTHGSESDGHSHGSQEGGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMKIGV

SEQ ID NO: 177 - protein, 251 aa, Homo sapiens
MAGTTDREEATRLLAEKRRQAREQREREEQERRLQAERDKRMREEQLAREAEARAEREAEARRREEQEAREKAQAEQEEQERLQKQKEEAEARSREEAERQRLEREKHFQQQEQERQERRKRLEEIMKRTRKSEVSETKKQDSKEANANGSSPEPVKAVEARSPGLQKEAVQKEEPIPQEPQWSLPSKELPASLVNGLQPLPAHQENGFSTNGPSGDKSLSRTPETLLPFAEAEAFLKKAVVQSPQVTEVL

SEQ ID NO: 178 - protein, 71 aa, Homo sapiens
SSKTASTNNIAQARRTVQQLRLEASIERIKVSKASADLMSYCEEHARSDPLLIGIPTSENPFKDKKTCIIL

SEQ ID NO: 179 - protein, 292 aa, Homo sapiens
MNLNMGREMKEELEEEEKMREDGGGKDRAKSKKVHRIVSKWMLPEKSRGTYLERANCFPPPVFIISISLAELAVFIYYAVWKPQKQWITLDTGILESPFIYSPEKREEAWRFISYMLVHAGVQHILGNLCMQLVLGIPLEMVHKGLRVGLVYLAGVIAGSLASSIFDPLRYLVGASGGVYALMGGYFMNVLVNFQEMIPAFGIFRLLIIILIIVLDMGFALYRRFFVPEDGSPVSFAAHIAGGFAGMSIGYTVFSCFDKALLKDPRFWIAIAAYLACVLFAVFFNIFLSPAN

SEQ ID NO: 180 - protein, 775 aa, Homo sapiens
MASRAVVRARRCPQCPQVRAAAAAPAWAALPLSRSLPPCSNSSSFSMPLFLLLLLVLLLLLEDAGAQQGDGCGHTVLGPESGTLTSINYPQTYPNSTVCEWEIRVKMGERVRIKFGDFDIEDSDSCHFNYLRIYNGIGVSRTEIGKYCGLGLQMNHSIESKGNEITLLFMSGIHVSGRGFLASYSVIDKQDLITCLDTASNFLEPEFSKYCPAGCLLPFAEISGTIPHGYRDSSPLCMAGVHAGVVSNTLGGQISVVISKGIPYYESSLANNVTSVVGHLSTSLFTFKTSGCYGTLGMESGVIADPQITASSVLEWTDHTGQENSWKPKKARLKKPGPPWAAFATDEYQWLQIDLNKEKKITGIITTGSTMVEHNYYVSAYRILYSDDGQKWTVYREPGVEQDKIFQGNKDYHQDVRNNFLPPIIARFIRVNPTQWQQKIAMKMELLGCQFIPKGRPPKLTQPPPPRNSNDLKNTTAPPKIAKGRAPKFTQPLQPRSSNEFPAQTEQTTASPDIRNTTVTPNVTKDVALAAVLVPVLVMVLTTLILILVCAWHWRNRKKKTEGTYDLPYWDRAGWWKGMKQFLPAKAVDHEETPVRYSSSEVNHLSPREVTTVLQADSAEYAQPLVGGIVGTLHQRSTFKPEEGKEAGYADLDPYNSPGQEVYHAYAEPLPITGPEYATPIIMDMSGHPTTSVGQPSTSTFKATGNQPPPLVGTYNTLLSRTDSCSSAQAQYDTPKAGKPGLPAPDELVYQVPQSTQEVSGAGRDGECDVFKEIL

SEQ ID NO: 181 - protein, 494 aa, Homo sapiens
ENYKNLVAVDWESHINTKWSAPQQNFLQGKTSSVVEMERNHFGEELFDFNQCEKALSEHSCLKTHRRTYFRKKTCECNQCEKAFRKPSIFTLHKKTDIGEELPNCNQCETAFSQHLHLVCKKTSQNLHLVCKKTHTQEKPYKCSDCEKGLPSSSHLRECVRIYGGERPYTHKEYVETFSHSTALFVHMQTQDGEKFYECKACGKPFTESSYLTQHLRTHSRVLPIEHKKFGKAFAFSPDLAKHIRLRTRGKHYVCNECGKEFTCFSKLNIHIRVHTGEKPYECNKCGKAFTDSSGLIKHRRTHTGEKPYECKECGKAFANSSHLTVHMRTHTGEKPYQCKECGKAFINSSSFKSHMQTHPGVKPYDCQQCGKAFIRSSFLIRHLRSHSAERPFECEECGKAFRYSSHLSQHKRIHTGERPYKCQKCGQAFSISSGLTVHMRTHTGERPFECQECGKAFTRSTYLIRHLRSHSVEKPYKECGQTFSNSSCLTECV

SEQ ID NO: 182 - protein, 556 aa, Homo sapiens
MMNKLYIGNLSPAVTADDLRQLFGDRKLPLAGQVLLKSGYAFVDYPDQNWAIRAIETLSGKVELHGKIMEVDYSVSKKLRSRKIQIRNIPPHLQWEVLDGLLAQYGTVENVEQVNTDTETAVVNVTYATREEAKIAMEKLSGHQFENYSFKISYIPDEEVSSPSPPQRAQRGDHSSREQGHAPGGTSQARQIDFPLRILVPTQFVGAIIGKEGLTIKNITKQTQSRVDIHRKENSGAAEKPVTIHATPEGTSEACRMILEIMQKEADETKLAEEIPLKILAHNGLVGRLIGKEGRNLKKIEHETGTKITISSLQDLSIYNPERTITVKGTVEACASAEIEIMKKLREAFENDMLAVNTHSGYFSSLYPHHQFGPFPHHHSYPEQEIVNLFIPTQAVGAIIGKKGAHIKQLARFAGASIKIAPAEGPDVSERMVIITGPPEAQFKAQGRIFGKLKEENFFNPKEEVKLEAHIRVPSSTAGRVIGKGGKTVNELQNLTSAEVIVPRDQTPDENEEVIVRIIGHFFASQTAQRKIREIVQQVKQQEQKYPQGVASQRSK

SEQ ID NO: 183 - protein, 399 aa, Homo sapiens
MSDILRELLCVSEKAANIARACRQQEALFQLLIEEKKEGEKNKKFAVDFKTLADVLVQEVIKQNMENKFPGLEKNIFGEESNEFTNDWGEKITLRLCSTEEETAELLSKVLNGNKVASEALARVVHQDVAFTDPTLDSTEINVPQDILGIWVDPIDSTYQYIKGSADIKSNQGIFPCGLQCVTILIGVYDIQTGVPLMGVINQPFVSRDPNTLRWKGQCYWGLSYMGTNMHSLQLTISRRNGSETHTGNTGSEAAFSPSFSAVISTSEKETIKAALSRVCGDRIFGAAGAGYKSLCVVQGLVDIYIFSEDTTFKWDSCAAHAILRAMGGGIVDLKECLERNPETGLDLPQLVYHVENEGAAGVDRWANKGGLIAYRSRKRLETFLSLLVQNLAPAETHT

SEQ ID NO: 184 - protein, 662 aa, Homo sapiens
PLCPALCPTSPPPLPLLPPSVSPPGCLTLWSLSFLFSVPSAPYPHLKTTMATIPDWKLQLLARRRQEEASVRGREKAERERLSQMPAWKRGLLERRRAKLGLSPGEPSPVLGTVEAGPPDPDESAVLLEAIGPVHQNRFIRQERQQQQQQQQRSEELLAERKPGPLEARERRPSPGEMRDQSPKGRESREERLSPRETRERRLGIGGAQELSLRPLEARDWRQSPGEVGDRSSRLSEAWKWRLSPGETPERSLRLAESREQSPRRKEVESRLSPGESAYQKLGLTEAHKWRPDSRESQEQSLVQLEATEWRLRSGEERQDYSEECGRKEEWPVPGVAPKETAELSETLTREAQGNSSAGVEAAEQRPVEDGERGMKPTEGWKWTLNSGKAREWTPRDIEAQTQKPEPPESAEKLLESPGVEAGEGEAEKEEAGAQGRPLRALQNCCSVPSPLPPEDAGTGGLRQQEEEAVELQPPPPAPLSPPPPAPTAPQPPGDPLMSRLFYGVKAGPGVGAPRRSGHTFTVNPRRSVPPATPATPTSPATVDAAVPGAGKKRYPTAEEILVLGGYLRLSRSCLAKGSPERHHKQLKISFSETALETTYQYPSESSVLEELGPEPEVPSAPNPPAAQPDDEEDEEELLLLQPELQGGLRTKALIVDESCRR

SEQ ID NO: 185 - protein, 1609 aa, Homo sapiens [sequence omitted]

SEQ ID NO: 186 - protein, 1408 aa, Homo sapiens
MKAPAVLAPGILVLLFTLVQRSNGECKEALAKSEMNVNMKYQLPNFTAETPIQNVILHEHHIFLGATNYIYVLNEEDLQKVAEYKTGPVLEHPDCFPCQDCSSKANLSGGVWKDNINMALVVDTYYDDQLISCGSVNRGTCQRHVFPHNHTADIQSEVHCIFSPQIEEPSQCPDCVVSALGAKVLSSVKDRFINFFVGNTINSSYFPDHPLHSISVRRLKETKDGFMFLTDQSYIDVLPEFRDSYPIKYVHAFESNNFIYFLTVQRETLDAQTFHTRIIRFCSINSGLHSYMEMPLECILTEKRKKRSTKKEVFNILQAAYVSKPGAQLARQIGASLNDDILFGVFAQSKPDSAEPMDRSAMCAFPIKYVNDFFNKIVNKNNVRCLQHFYGPNHEHCFNRTLLRNSSGCEARRDEYRTEFTTALQRVDLFMGQFSEVLLTSISTFIKGDLTIANLGTSEGRFMQVVVSRSGPSTPHVNFLLDSHPVSPEVIVEHTLNQNGYTLVITGKKITKIPLNGLGCRHFQSCSQCLSAPPFVQCGWCHDKCVRSEECLSGTWTQQICLPAIYKVFPNSAPLEGGTRLTICGWDFGFRRNNKFDLKKTRVLLGNESCTLTLSESTMNTLKCTVGPAMNKHFNMSIIISNGHGTTQYSTFSYVDPVITSISPKYGPMAGGTLLTLTGNYLNSGNSRHISIGGKTCTLKSVSNSILECYTPAQTISTEFAVKLKIDLANRETSIFSYREDPIVYEIHPTKSFISTWWKEPLNIVSFLFCFASGGSTITGVGKNLNSVSVPRMVINVHEAGRNFTVACQHRSNSEIICCTTPSLQQLNLQLPLKTKAFFMLDGILSKYFDLIYVHNPVFKPFEKPVMISMGNENVLEIKGNDIDPEAVKGEVLKVGNKSCENIHLHSEAVLCTVPNDLLKLNSELNIEWKQAISSTVLGKVIVQPDQNFTGLIAGVVSISTALLLLLGFFLWLKKRKQIKDLGSELVRYDARVHTPHLDRLVSARSVSPTTEMVSNESVDYRATFPEDQFPNSSQNGSCRQVQYPLTDMSPILTSGDSDISSPLLQNTVHIDLSALNPELVQAVQHVVIGPSSLIVHFNEVIGRGHFGCVYHGTLLDNDGKKIHCAVKSLNRITDIGEVSQFLTEGIIMKDFSHPNVLSLLGICLRSEGSPLVVLPYMKHGDLRNFIRNETHNPTVKDLIGFGLQVAKAMKYLASKKFVHRDLAARNCMLDEKFTVKVADFGLARDMYDKEYYSVHNKTGAKLPVKWMALESLQTQKFTTKSDVWSFGVVLWELMTRGAPPYPDVNTFDITVYLLQGRRLLQPEYCPDPLYEVMLKCWHPKAEMRPSFSELVSRISAIFSTFIGEHYVHVNATYVNVKCVAPYPSLLSSEDNADDEVDTRPASFWETS

SEQ ID NO: 187 - protein, 577 aa, Homo sapiens
MPKTISVRVTTMDAELEFAIQPNTTGKQLFDQVVKTIGLREVWFFGLQYQDTKGFSTWLKLNKKVTAQDVRKESPLLFKFRAKFYPEDVSEELIQDITQRLFFLQVKEGILNDDIYCPPETAVLLASYAVQSKYGDFNKEVHKSGYLAGDKLLPQRVLEQHKLNKDQWEERIQVWHEEHRGMLREDAVLEYLKIAQDLEMYGVNYFSIKNKKGSELWLGVDALGLNIYEQNDRLTPKIGFPWSEIRNISFNDKKFVIKPIDKKAPDFVFYAPRLRINKRILALCMGNHELYMRRRKPDTIEVQQMKAQAREEKHQKQMERAMLENEKKKREMAEKEKEKIEREKEELMERLKQIEEQTKKAQQELEEQTRRALELEQERKRAQSEAEKLAKERQEAEEAKEALLQASRDQKKTQEQLALEMAELTARISQLEMARQKKESEAVEWQQKAQMVQEDLEKTRAELKTAMSTPHVAEPAENEQDEQDENGAEASADLRADAMAKDRSEEERTTEAEKNERVQKHLKALTSELANARDESKKTANDMIHAENMRLGRDKYKTLRQIRQGNTKQRIDEFESM

SEQ ID NO: 188 - protein, 2058 aa, Homo sapiens
MDNFFTEGTRVWLRENGQHFPSTVNSCAEGIVVFRTDYGQVFTYKQSTITHQKVTAMHPTNEEGVDDMASLTELHGGSIMYNLFQRYKRNQIYTYIGSILASVNPYQPIAGLYEPATMEQYSRRHLGELPPHIFAIANECYRCLWKRYDNQCILISGESGAGKTESTKLILKFLSVISQQSLELSLKEKTSCVERAILESSPIMEAFGNAKTVYNNNSSRFGKFVQLNICQKGNIQGGRIVDYLLEKNRVVRQNPGERNYHIFYALLAGLEHEEREEFYLSTPENYHYLNQSGCVEDKTISDQESFREVITAMDVMQFSKEEVREVSRLLAGILHLGNIEFITAGGAQVSFKTALGRSAELLGLDPTQLTDALTQRSMFLRGEEILTPLNVQQAVDSRDSLAMALYACCFEWVIKKINSRIKGNEDFKSIGILDIFGFENFEVNHFEQFNINYANEKLQEYFNKHIFSLEQLEYSREGLVWEDIDWIDNGECLDLIEKKLGLLALINEESHFPQATDSTLLEKLHSQHANNHFYVKPRVAVNNFGVKHYAGEVQYDVRGILEKNRDTFRDDLLNLLRESRFDFIYDLFEHVSSRNNQDTLKCGSKHRRPTVSSQFKDSLHSLMATLSSSNPFFVRCIKPNMQKMPDQFDQAVVLNQLRYSGMLETVRIRKAGYAVRRPFQDFYKRYKVLMRNLALPEDVRGKCTSLLQLYDASNSEWQLGKTKVFLRESLEQKLEKRREEEVSHAAMVIRAHVLGFLARKQYRKVLYCVVIIQKNYRAFLLRRRFLHLKKAAIVFQKQLRGQIARRVYRQLLAEKREQEEKKKQEEEEKKKREEEERERERERREAELRAQQEEETRKQQELEALQKSQKEAELTRELEKQKENKQVEEILRLEKEIEDLQRMKEQQELSLTEASLQKLQERRDQELRRLEEEACRAAQEFLESLNFDEIDECVRNIERSLSVGSEFSSELAESACEEKPNFNFSQPYPEEEVDEGFEADDDAFKDSPNPSEHGHSDQRTSGIRTSDDSSEEDPYMNDTVVPTSPSADSTVLLAPSVQDSGSLHNSSSGESTYCMPQNAGDLPSPDGDYDYDQDDYEDGAITSGSSVTFSNSYGSQWSPDYRCSVGTYNSSGAYRFSSEGAQSSFEDSEEDFDSRFDTDDELSYRRDSVYSCVTLPYFHSFLYMKGGLMNSWKRRWCVLKDETFLWFRSKQEALKQGWLHKKGGGSSTLSRRNWKKRWFVLRQSKLMYFENDSEEKLKGTVEVRTAKEIIDNTTKENGIDIIMADRTFHLIAESPEDASQWFSVLSQVHASTDQEIQEMHDEQANPQNAVGTLDVGLIDSVCASDSPDRPNSFVIITANRVLHCNADTPEEMHHWITLLQRSKGDTRVEGQEFIVRGWLHKEVKNSPKMSSLKLKKRWFVLTHNSLDYYKSSEKNALKLGTLVLNSLCSVVPPDEKIFKETGYWNVTVYGRKHCYRLYTKLLNEATRWSSAIQNVTDTKAPIDTPTQQLIQDIKENCLNSDVVEQIYKRNPILRYTHHPLHSPLLPLPYGDINLNLLKDKGYTTLQDEAIKIFNSLQQLESMSDPIPIIQGILQTGHDLRPLRDELYCQLIKQTNKVPHPGSVGNLYSWQILTCLSCTFLPSRGILKYLKFHLKRIREQFPGTEMEKYALFTYESLKKTKCREFVPSRDEIEALIHRQEMTSTVYCHGGGSCKITINSHTTAGEVVEKLIRGLAMEDSRNMFALFEYNGHVDKAIESRTVVADVLAKFEKLAATSEVGDLPWKFYFKLYCFLDTDNVPKDSVEFAFMFEQAHEAVIHGHHPAPEENLQVLAALRLQYLQGDYTLHAAIPPLEEVYSLQRLKARISQSTKTFTPCERLEKRRTSFLEGTLRRSFRTGSVVRQKVEEEQMLDMWIKEEVSSARASIIDKWRKFQGMNQEQAMAKYMALIKEWPGYGSTLFDVECKEGGFPQELWLGVSADAVSVYKRGEGRPLEVFQYEHILSFGAPLANTYKIVVDERELLFETSEVVDVAKLMKAYISMIVKKRYSTTRSASSQGSSR

SEQ ID NO: 189 - protein, 562 aa, Homo sapiens
MVKIVTVKTQAYQDQKPGTSGLRKRVKVFQSSANYAENFIQSIISTVEPAQRQEATLVVGGDGRFYMKEAIQLIARIAAANGIGRLVIGQNGILSTPAVSCIIRKIKAIGGIILTASHNPGGPNGDFGIKFNISNGGPAPEAITDKIFQISKTIEEYAVCPDLKVDLGVLGKQQFDLENKFKPFTVEIVDSVEAYATMLRSIFDFSALKELLSGPNRLKICIDAMHGVVGPYVKKILCEELGAPANSAVNCVPLEDFGGHHPDPNLTYAADLVETMKSGEHDFGAAFDGDGDRNMILGKHGFFVNPSDSVAVIAANIFSIPYFQQTGVRGFARSMPTSGALDRVASATKIALYETPTGWKFFGNLMDASKLSLCGEESFGTGSDHIREKDGLWAVLAWLSILATRKQSVEDILKDHWQKHGRNFFTRYDYEEVEAEGANKMMKDLEALMFDRSFVGKQFSANDKVYTVEKADNFEYSDPVDGSISRNQGLRLIFTDGSRIVFRLSGTGSAGATIRLYIDSYEKDVAKINQDPQVMLAPLISIALKVSQLQERTGRTAPTVIT

SEQ ID NO: 190 - protein, 204 aa, Homo sapiens
GEGERPEEDAAALELSSDEAVEVEEVIEESRAERIKRSGLRRVDDFKKAFSKEKMEKTKVRTRENLEKTRLKTKENLEKTRHTLEKRMNKLGTRLVPAERREKLKTSRDKLRKSFTPDHVVYARSKTAVYKVPPFTFHVKKIREGQVEVLKATEMVEVGADDDEGGAERGEAGDLRRGSSPDVHALLEITEESDAVLVDKSDSD

SEQ ID NO: 191 - protein, 345 aa, Homo sapiens
MSLFGLLLLTSALAGQRQGTQAESNLSSKFQFSSNKEQNGVQDPQHERIITVSTNGSIHSPRFPHTYPRNTVLVWRLVAVEENVWIQLTFDERFGLEDPEDDICKYDFVEVEEPSDGTILGRWCGSGTVPGKQISKGNQIRIRFVSDEYFPSEPGFCIHYNIVMPQFTEAVSPSVLPPSALPLDLLNNAITAFSTLEDLIRYLEPERWQLDLEDLYRPTWQLLGKAFVFGRKSRVVDLNLLTEEVRLYSCTPRNFSVSIREELKRTDTIFWPGCLLVKRCGGNCACCLHNCNECQCVPSKVTKKYHEVLQLRPKTGVRGLHKSLTDVALEHHEECDCVCRGSTGG

SEQ ID NO: 192 - protein, 1261 aa, Homo sapiens
MIAHKQKKTKKKRAWASGQLSTDITTSEMGLKSLSSNSIFDPDYIKELVNDIRKFSHILLYLKEAIFSDCFKEVIHIRLEELLRVLKSIMNKHQNLNSVDLQNAAEMLTAKVKAVNFTEVNEENKNDLFQEVFSSIETLAFTFGNILTNFLMGDVGNDSFLRLPVSRETKSFENVSVESVDSSSEKGNFSPLELDNVLLKNTDSIELALSYAKTWSKYTKNIVSWVEKKLNLELESTRNMVKLAEATRTNIGIQEFMPLQSLFTNALLNDIESSHLLQQTIAALQANKFVQPLLGRKNEMEKQRKEIKELWKQEQNKMLEAENALKKAKLLCMQRQDEYEKAKSSMFRAEEEHLSSSGGLAKNLNKQLEKKRRLEEEALQKVEEADELYKVCVTNVEERRNDVENTKREILAQLRTLVFQCDLTLKAVTVNLFHMQHLQAASLADRLQSLCGSAKLYDPGQEYSEFVKATNSTEEEKVDGNVNKHLNSSQPSGFGPANSLEDVVRLPDSSNKIEEDRCSNSADITGPSFIRSWTFGMFSDSESTGGSSESRSLDSESISPGDFHRKLPRTPSSGTMSSADDLDEREPPSPSETGPNSLGTFKKTLMSKAALTHKFRKLRSPTKCRDCEGIVVFQGVECEECLLVCHRKCLENLVIICGHQKLPGKIHLFGAEFTLVAKKEPDGIPFILKICASEIENRALCLQGIYRVCGNKIKTEKLCLALENGMHLVDISEFSSHDICDVLKLYLRQLPEPFILFRLYKEFIDLAKEIQHVNEEQETKKNSLEDKKWPNMCIEINRILLKSKDLLRQLPASNFNSLHFLIVHLKRVVDHAEENKMNSKNLGVIFGPSLIRPRPQTAPITISSLAEYSNQARLVEFLITYSQKIFDGSLQPQDVMCSIGVVDQGCFPKPLLSPEERDIERSMKSLFFSSKEDIHTSESESKIFERATSFEESERKQNALGKCDACLSDKAQLLLDQEAESASQKIEDGKAPKPLSLKSDRSTNNVERHTPRTKIRPVSLPVDRLLLASPPNERNGRNMGNVNLDKFCKNPAFEGVNRKDAATTVCSKFNGFDQQTLQKIQDKQYEQNSLTAKTTMIMPSALQEKGVTTSLQISGDHSINATQPSKPYAEPVRSVREASERRSSDSYPLAPVRAPRTLQPQHWTTFYKPHAPIISIRGNEEKPASPSAACPPGTDHDPHGLVVKSMPDPDKASACPGQATGQPKEDSEELGLPDVNPMCQRPRLKRMQQFEDLEDEIPQFV

SEQ ID NO: 193 - protein, 192 aa, Homo sapiens
MQAIKCVVVGDGAVGKTCLLISYTTNAFPGEYIPTVFDNYSANVMVDSKPVNLGLWDTAGQEDYDRLRPLSYPQTDVFLICFSLVSPASYENVRAKWFPEVRHHCPSTPIILVGTKLDLRDDKDTIEKLKEKKLAPITYPQGLALAKEIDSVKYLECSALTQRGLKTVFDEAIRAVLCPQPTRQQKRACSLL

SEQ ID NO: 194 - protein, 404 aa, Homo sapiens
MDSRTKSKDYCKVIFPYEAQNDDELTIKEGDIVTLINKDCIDVGWWEGELNGRRGVFPDNFVKLLPPDFEKEGNRPKKPPPPSAPVIKQGAGTTERKHEIKKIPPERPEMLPNRTEEKERPEREPKLDLQKPSVPAIPPKKPRPPKTNSLSRPGALPPRRPERPVGPLTHTRGDSPKIDLAGSSLSGILDKDLSDRSNDIDLEGFDSVVSSTEKLSHPTTSRPKATGRRPPSQSLTSSSLSSPDIFDSPSPEEDKEEHISLAHRGVDASKKTSKTVTISQVSDNKASLPPKPGTMAAGGGGPAPLSSAAPSPLSSSLGTAGHRANSPSLFGTEGKPKMEPAASSQAAVEELRTQVRELRSIIETMKDQQKREIKQLLSELDEEKKIRLRLQMEVNDIKKALQSK

SEQ ID NO: 195 - protein, 268 aa, Homo sapiens
MPRSFLVKKHFNASKKPNYSELDTHTVIISPYLYESYSMPVIPQPEILSSGAYSPITVWTTAAPFHAQLPNGLSPLSGYSSSLGRVSPPPPSDTSSKDHSGSESPISDEEERLQSKLSDPHAIEAEKFQCNLCNKTYSTFSGLAKHKQLHCDAQSRKSFSCKYCDKEYVSLGALKMHIRTHTLPCVCKICGKAFSRPWLLQGHIRTHTGEKPFSCPHCNRAFADRSNLRAHLQTHSDVKKYQCKNCSKTFSRMSLLHKHEESGCCVAH

SEQ ID NO: 196 - protein, 490 aa, Homo sapiens
MSEVTKNSLEKILPQLKCHFTWNLFKEDSVSRDLEDRVCNQIEFLNTEFKATMYNLLAYIKHLDGNNEAALECLRQAEELIQQEHADQAEIRSLVTWGNYAWVYYHLGRLSDAQIYVDKVKQTCKKFSNPYSIEYSELDCEEGWTQLKCGRNERAKVCFEKALEEKPNNPEFSSGLAIAMYHLDNHPEKQFSTDVLKQAIELSPDNQYVKVLLGLKLQKMNKEAEGEQFVEEALEKSPCQTDVLRSAAKFYRRKGDLDKAIELFQRVLESTPNNGYLYHQIGCCYKAKVRQMQNTGESEASGNKEMIEALKQYAMDYSNKALEKGLNPLNAYSDLAEFLETECYQTPFNKEVPDAEKQQSHQRYCNLQKYNGKSEDTAVQHGLEGLSISKKSTDKEEIKDQPQNVSENLLPQNAPNYWYLQGLIHKQNGDLLQAAKCYEKELGRLLRDAPSGIGSIFLSASELEDGSEEMGQGAVSSSPRELLSNSEQLN

SEQ ID NO: 197 - protein, 567 aa, Homo sapiens
MGRGLLRGLWPLHIVLWTRIASTIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDLLLVIFQVTGISLLPPLGVAISVIIIFYCYRVNRQQKLSSTWETGKTRKLMEFSEHCAIILEDDRSDISSTCANNINHNTELLPIELDTLVGKGRFAEVYKAKLKQNTSEQFETVAVKIFPYEEYASWKTEKDIFSDINLKHENILQFLTAEERKTELGKQYWLITAFHAKGNLQEYLTRHVISWEDLRKLGSSLARGIAHLHSDHTPCGRPKMPIVHRDLNSSNILVKNDLTCCLCDFGLSLRLDPTLSVDDLANSGQVGTARYMAPEVLESRMNLENAESFKQTDVYSMALVLWEMTSRCNAVGEVKDYEPPFGSKVREHPCVESMKDNVLRDRGRPEIPSFWLNHQGIQMVCETLTECWDHDPEARLTAQCVAERFSELEHLDRLSGRSCSEEKIPEDGSLNTTK

SEQ ID NO: 198 - protein, 425 aa, Homo sapiens
MSSILPFTPPIVKRLLGWKKGEQNGQEEKWCEKAVKSLVKKLKKTGQLDELEKAITTQNVNTKCITIPRSLDGRLQVSHRKGLPHVIYCRLWRWPDLHSHHELRAMELCEFAFNMKKDEVCVNPYHYQRVETPVLPPVLVPRHTEIPAEFPPLDDYSHSIPENTNFPAGIEPQSNIPETPPPGYLSEDGETSDHQMNHSMDAGSPNLSPNPMSPAHNNLDLQPVTYCEPAFWCSISYYELNQRVGETFHASQPSMTVDGFTDPSNSERFCLGLLSNVNRNAAVELTRRHIGRGVRLYYIGGEVFAECLSDSAIFVQSPNCNQRYGWHPATVCKIPPGCNLKIFNNQEFAALLAQSVNQGFEAVYQLTRMCTIRMSFVKGWGAEYRRQTVTSTPCWIELHLNGPLQWLDKVLTQMGSPSIRCSSVS

SEQ ID NO: 199 - protein, 655 aa, Homo sapiens
MGTSPSSSTALASCSRIARRATATMIAGSLLLLGFLSTTTAQPEQKASNLIGTYRHVDRATGQVLTCDKCPAGTYVSEHCTNTSLRVCSSCPVGTFTRHENGIEKCHDCSQPCPWPMIEKLPCAALTDRECTCPPGMFQSNATCAPHTVCPVGWGVRKKGTETEDVRCKQCARGTFSDVPSSVMKCKAYTDCLSQNLVVIKPGTKETDNVCGTLPSFSSSTSPSPGTAIFPRPEHMETHEVPSSTYVPKGMNSTESNSSASVRPKVLSSIQEGTVPDNTSSARGKEDVNKTLPNLQVVNHQQGPHHRHILKLLPSMEATGGEKSSTPIKGPKRGHPRQNLHKHFDINEHLPWMIVLFLLLVLVVIVVCSIRKSSRTLKKGPRQDPSAIVEKAGLKKSMTPTQNREKWIYYCNGHGIDILKLVAAQVGSQWKDIYQFLCNASEREVAAFSNGYTADHERAYAALQHWTIRGPEASLAQLISALRQHRRNDVVEKIRGLMEDTTQLETDKLALPMSPSPLSPSPIPSPNAKLENSALLTVEPSPQDKNKGFFVDESEPLLRCDSTSSGSSALSRNGSFITKEKKDTVLRQVRLDPCDLQPIFDDMLHFLNPEELRVIEEIPQAEDKLDRLFEIIGVKSQEASQTLLDSVYSHLPDLL

SEQ ID NO: 200 - protein, 207 aa, Homo sapiens
MSSDRQRSDDESPSTSSGSSDADQRDPAAPEPEEQEERKPSATQQKKNTKLSSKTTAKLSTSAKRIQKELAEITLDPPPNCSAGPKGDNIYEWRSTILGPPGSVYEGGVFFLDITFSSDYPFKPPKVTFRTRIYHCNINSQGVICLDILKDNWSPALTISKVLLSICSLLTDCNPADPLVGSIATQYLTNRAEHDRIARQWTKRYAT

SEQ ID NO: 201 - protein, 572 aa, Homo sapiens
MAAPRPSPAISVSVSAPAFYAPQKKFGPVVAPKPKVNPFRPGDSEPPPAPGAQRAQMGRVGEIPPPPPEDFPLPPPPLAGDGDDAEGALGGAFPPPPPPIEESFPPAPLEEEIFPSPPPPPEEEGGPEAPIPPPPQPREKVSSIDLEIDSLSSLLDDMTKNDPFKARVSSGYVPPPVATPFSSKSSTKPAAGGTAPLPPWKSPSSSQPLPQVPAPAQSQTQFHVQPQPQPKPQVQLHVQSQTQPVSLANTQPRGPPASSPAPAPKFSPVTPKFTPVASKFSPGAPGGSGSQPNQKLGHPEALSAGTGSPQPPSFTYAQQREKPRVQEKQHPVPPPAQNQNQVRSPGAPGPLTLKEVEELEQLTQQLMQDMEHPQRQNVAVNELCGRCHQPLARAQPAVRALGQLFHIACFTCHQCAQQLQGQQFYSLEGAPYCEGCYTDTLEKCNTCGEPITDRMLRATGKAYHPHCFTCVVCARPLEGTSFIVDQANRPHCVPDYHKQYAPRCSVCSEPIMPEPGRDETVRVVALDKNFHMKCYKCEDCGKPLSIEADDNGCFPLDGHVLCRKCHTARAQT

SEQ ID NO: 202 - protein, 141 aa, Homo sapiens
MTKQHELGGLLALVQNCQSEMNIKDSRAVGLSVKRLCISFVDEFCERTERPLYLAQGLFMKRETYWEVQDSGISPLLLLLSTALDCSPEAETRQSPGGRKMLQEPTLSMSLQILTGFLWVQLWNWETFLRIRTHSTDASCP

SEQ ID NO: 203 - protein, 430 aa, Homo sapiens
MDEQPRLMHSHAGVGMAGHPGLSQHLQDGAGGTEGEGGRKQDIGDILQQIMTITDQSLDEAQARKHALNCHRMKPALFNVLCEIKEKTVLSIRGAQEEEPTDPQLMRLDNMLLAEGVAGPEKGGGSAAAAAAAAASGGAGSDNSVEHSDYRAKLSQIRQIYHTELEKYEQACNEFTTHVMNLLREQSRTRPISPKEIERMVSIIHRKFSSIQMQLKQSTCEAVMILRSRFLDARRKRRNFNKQATEILNEYFYSHLSNPYPSEEAKEELAKKCGITVSQVSNWFGNKRIRYKKNIGKFQEEANIYAAKTAVTATNVSAHGSQANSPSTPNSAGSSSSFNMSNSGDLFMSVQSLNGDSYQGAQVGANVQSQVDTLRHVISQTGGYSDGLAASQMYSPQGISANGGWQDATTPSSVTSPTEGPGSVHSDTSN

SEQ ID NO: 204 - protein, 384 aa, Homo sapiens
ARGVASMTMNVIQTVPNLDWLSVWIKAYAFVHTGDNSRAISTICSLEKKSLLRDNVDLLGSLADLYFRAGDNKNSVLKFEQAQMLDPYLIKGMDVYGYLLAREGRLEDVENLGCRLFNISDQHAEPWVVSGCHSFYSKRYSRALYLGAKAIQLNSNSVQALLLKGAALRNMGRVQEAIIHFREAIRLAPCRLDCYEGLIECYLASNSIREAMVMANNVYKTLGANAQTLTLLATVCLEDPVTQEKAKTLLDKALTQRPDYIKAVVKKAELLSREQKYEDGIALLRNALANQSDCVLHRILGDFLVAVNEYQEAMDQYSIALSLDPNDQKSLEGMQKMEKEESPTDATQEEDVDDMEGSGEEGDLEGSDSEAAQWADQEQWFGMQ

SEQ ID NO: 205 - protein, 1659 aa, Homo sapiens
MEAPSGSEPGGDGAGDCAHPDPRAPGAAAPSSGPGPCAAARESERQLRLRLCVLNEILGTERDYVGTLRFLQSAFLHRIRQNVADSVEKGLTEENVKVLFSNIEDILEVHKDFLAALEYCLHPEPQSQHELGNVFLKFKDKFCVYEEYCSNHEKALRLLVELNKIPTVRAFLLSCMLLGGRKTTDIPLEGYLLSPIQRICKYPLLLKELAKRTPGKHPDHPAVQSALQAMKTVCSNINETKRQMEKLEALEQLQSHIEGWEGSNLTDICTQLLLQGTLLKISAGNIQERAFFLFDNLLVYCKRKSRVTGSKKSTKRTKSINGSLYIFRGRINTEVMEVENVEDGTADYHSNGYTVTNGWKIHNTAKNKWFVCMAKTAEEKQKWLDAIIREREQRESLKLGMERDAYVMIAEKGEKLYHMMMNKKVNLIKDRRRKLSTVPKCFLGNEFVAWLLEIGEISKTEEGVNLGQALLENGIIHHVSDKHQFKNEQVMYRFRYDDGTYKARSELEDIMSKGVRLYCRLHSLYTPVIKDRDYHLKTYKSVLPGSKLVDWLLAQGDCQTREEAVALGVGLCNNGFMHHVLEKSEFRDESQYFRFHADEEMEGTSSKNKQLRNDFKLVENILAKRLLILPQEEDYGFDIEEKNKAVVVKSVQRGSLAEVAGLQVGRKIYSINEDLVFLRPFSEVESILNQSFCSRRPLRLLVATKAKEIIKIPDQPDTLCFQIRGAAPPYVYAVGRGSEAMAAGLCAGQCILKVNGSNVMNDGAPEVLEHFQAFRSRREEALGLYQWIYHTHEDAQEARASQEASTEDPSGEQAQEEDQADSAFPLLSLGPRLSLCEDSPMVTLTVDNVHLEHGVVYEYVSTAGVRCHVLEKIVEPRGCFGLTAKILEAFAANDSVFVENCRRLMALSSAIVTMPHFEFRNICDTKLESIGQRIACYQEFAAQLKSRVSPPFKQAPLEPHPLCGLDFCPTNCHINLMEVSYPKTTPSVGRSFSIRFGRKPSLIGLDPEQGHLNPMSYTQHCITTMAAPSWKCLPAAEGDPQGQGLHDGSFGPASGTLGQEDRGLSFLLKQEDREIQDAYLQLFTKLDVALKEMKQYVTQINRLLSTITEPTSGGSCDASLAEEASSLPLVSEESEMDRSDHGGIKKVCFKVAEEDQEDSGHDTMSYRDSYSECNSNRDSVLSYTSVRSNSSYLGSDEMGSGDELPCDMRIPSDKQDKLHGCLEHLFNQVDSINALLKGPVMSRAFEETKHFPMNHSLQEFKQKEECTIRGRSLIQISIQEDPWNLPNSIKTLVDNIQRYVEDGKNQLLLALLKCTDTELQLRRDAIFCQALVAAVCTFSEQLLAALGYRYNNNGEYEESSRDASRKWLEQVAATGVLLHCQSLLSPATVKEERTMLEDIWVTLSELDNVTFSFKQLDENYVANTNVFYHIEGSRQALKVIFYLDSYHFSKLPSRLEGGASLRLHTALFTKVLENVEGLPSPGSQAAEDLQQDINAQSLEKVQQYYRKLRAFYLERSNLPTDASTTAVKIDQLIRPINALDELCRLMKSFVHPKPGAAGSVGAGLIPISSELCYRLGACQMVMCGTGMQRSTLSVSLEQAAILARSHGLLPKCIMQATDIMRKQGPRVEILAKNLRVKDQMPQGAPRLYRLCQPPVDGDL

SEQ ID NO: 206 - protein, 175 aa, Homo sapiens
MEKIPVSAFLLLVALSYTLARDTTVKPGAKKDTKDSRPKLPQTLSRGWGDQLIWTQTYEEALYKSKTSNKPLMIIHHLDECPHSQALKKVFAENKEIQKLAEQFVLLNLVYETTDKHLSPDGQYVPRIMFVDPSLTVRADITGRYSNRLYAYEPADTALLLDNMKKALKLLKTEL

SEQ ID NO: 207 - protein, 196 aa, Homo sapiens
MAAIRKKLVVVGDGACGKTCLLIVFSKDEFPEVYVPTVFENYVADIEVDGKQVELALWDTAGQEDYDRLRPLSYPDTDVILMCFSVDSPDSLENIPEKWVPEVKHFCPNVPIILVANKKDLRSDEHVRTELARMKQEPVRTDDGRAMAVRIQAYDYLECSAKTKEGVREVFETATRAALQKRYGSQNGCINCCKVL

SEQ ID NO: 208 - protein, 291 aa, Homo sapiens
MEKLAASTEPQGPRPVLGRESVQVPDDQDFRSFRSECEAEVGWNLTYSRAGVSVWVQAVEMDRTLHKIKCRMECCDVPAETLYDVLHDIEYRKKWDSNVIETFDIARLTVNADVGYYSWRCPKPLKNRDVITLRSWLPMGADYIIMNYSVKHPKYPPRKDLVRAVSIQTGYLIQSTGPKSCVITYLAQVDPKGSLPKWVVNKSSQFLAPKAMKKMYKACLKYPEWKQKHLPHFKPWLHPEQSPLPSLALSELSVQHADSLENIDESAVAESREERMGGAGGEGSDDDTSLT

SEQ ID NO: 209 - protein, 358 aa, Homo sapiens
MSADAAAGAPLPRLCCLEKGPNGYGFHLHGEKGKLGQYIRLVEPGSPAEKAGLLAGDRLVEVNGENVEKETHQQVVSRIRAALNAVRLLVVDPETDEQLQKLGVQVREELLRAQEAPGQAEPPAAAEVQGAGNENEPREADKSHPEQRELRPRLCTMKKGPSGYGFNLHSDKSKPGQFIRSVDPDSPAEASGLRAQDRIVEVNGVCMEGKQHGDVVSAIRAGGDETKLLVVDRETDEFFKKCRVIPSQEHLNGPLPVPFTNGEIQKENSREALAEAALESPRPALVRSASSDTSEELNSQDSPPKQDSTAPSSTSSSDPILDFNISLAMAKERAHQKRSSKRAPQMDWSKKNELFSNL

SEQ ID NO: 210 - protein, 345 aa, Homo sapiens
MQLEIQVALNFIISYLYNKLPRRRVNIFGEELERLLKKKYEGHWYPEKPYKGSGFRCIHIGEKVDPVIEQASKESGLDIDDVRGNLPQDLSVWIDPFEVSYQIGEKGPVKVLYVDDNNENGCELDKEIKNSFNPEAQVFMPISDPASSVSSSPSPPFGHSAAVSPTFMPRSTQPLTFTTATFAATKFGSTKMKNSGRSNKVARTSPINLGLNVNDLLKQKAISSSMHSLYGLGLGSQQQPQQQQQPAQPPPPPPPPQQQQQQKTSALSPNAKEFIFPNMQGQGSSTNGMFPGDSPLNLSPLQYSNAFDVFAAYGGLNEKSFVDGLNFSLNNMQYSNQQFQPVMAN

SEQ ID NO: 211 - protein, 84 aa, Homo sapiens
MATMENKVICALVLVSMLALGTLAEAQTETCTVAPRERQNCGFPGVTPSQCANKGCCFDDTVRGVPWCFYPNTIDVPPEEECEF

SEQ ID NO: 212 - protein, 522 aa, Homo sapiens
GFLPATKNLLNEKNHGVLHTSVVLLTEMCERSPDMLAHFRENEKLVPQLVRILKNLIMSGYSPGHDVSGISDPFLQVRILRLLRILGRNDDDSSEAMNDILAQVATNTETSKNVGNAILYETVLTIMDIKSESGLRVLAINILGRFLLNNDKNIRYVALTSLLKTVQTDHNAVQRHRSTIVDCLKDLDVSIKRRAMELSFALVNGNNIRGMMKELLYFLDSCEPEFKADCASGIFLAAEKYAPSKRWHIDTIMRVLTTAGSYVRDDAVPNLIQLITNSVEMHAYTVQRLYKAILGDYSQQPLVQVAAWCIGEYGDLLVSGQCEEEEPIQVTEDEVLDILESVLISNMSTSVTRGYALTAIMKLSTRFTCTVNRIKKVVSIYGSSIDVELQRRAVEYNALFKKYDHMRSALLERMPVMEKVTTNGPTEIVQTNGETEPAPLETKPPPSGPQPTSQANDLLDLLGGNDITPVIPTAPTSKPSSAGGELLDLLGDINLTGSHSVSQAGVQWDYLGSLQPLPPAFR

SEQ ID NO: 213 - protein, 1704 aa, Homo sapiens
MAVLRQLALLLWKNYTLQKRKVLVTVLELFLPLLFPGILIWLRLKIQSENVPNATIYPGQSIQELPLFFTFPPPGDTWELAYIPSHSDAAKTVTETVRRALVINMRVRGFPSEKDFEDYIRYDNCSSSVLAAVVFEHPFNHSKEPLPLAVKYHLRFSYTRRNYMWTQTGSFFLKETEGWHTTSLFPLFPNPGPRELTSPDGGEPGYIREGFLAVQHAVDRAIMEYHADAATRQLFQRLTVTIKRFPYPPFIADPFLVAIQYQLPLLLLLSFTYTALTIARAVVQEKERRLKEYMRMMGLSSWLHWSAWFLLFFLFLLIAASFMTLLFCVKVKPNVAVLSRSDPSLVLAFLLCFAISTISFSFMVSTFFSKANMAAAFGGFLYFFTYIPYFFVAPRYNWMTLSQKLCSCLLSNVAMAMGAQLIGKFEAKGMGIQWRDLLSPVNVDDDFCFGQVLGMLLLDSVLYGLVTWYMEAVFPGQFGVPQPWYFFIMPSYWCGKPRAVAGKEEEDSDPEKALRNEYFEAEPEDLVAGIKIKHLSKVFRVGNKDRAAVRDLNLNLYEGQITVLLGHNGAGKTTTLSMLTGLFPPTSGRAYISGYEISQDMVQIRKSLGLCPQHDILFDNLTVAEHLYFYAQLKGLSRQKCPEEVKQMLHIIGLEDKWNSRSRFLSGGMRRKLSIGIALIAGSKVLILDEPTSGMDAISRRAIWDLLQRQKSDRTIVLTTHFMDEADLLGDRIAIMAKGELQCCGSSLFLKQKYGAGYHMTLVKEPHCNPEDISQLVHHHVPNATLESSAGAELSFILPRESTHRFEGLFAKLEKKQKELGIASFGASITTMEEVFLRVGKLVDSSMDIQAIQLPALQYQHERRASDWAVDSNLCGAMDPSDGIGALIEEERTAVKLNTGLALHCQQFWAMFLKKAAYSWREWKMVAAQVLVPLTCVTLALLAINYSSELFDDPMLRLTLGEYGRTVVPFSVPGTSQLGQQLSEHLKDALQAEGQEPREVLGDLEEFLIFRASVEGGGFNERCLVAASFRDVGERTVVNALFNNQAYHSPATALAVVDNLLFKLLCGPHASIVVSNFPQPRSALQAAKDQFNEGRKGFDIALNLLFAMAFLASTFSILAVSERAVQAKHVQFVSGVHVASFWLSALLWDLISFLIPSLLLLVVFKAFDVRAFTRDGHMADTLLLLLLYGWAIIPLMYLMNFFFLGAATAYTRLTIFNILSGIATFLMVTIMRIPAVKLEELSKTLDHVFLVLPNHCLGMAVSSFYENYETRRYCTSSEVAAHYCKKYNIQYQENFYAWSAPGVGRFVASMAASGCAYLILLFLIETNLLQRLRGILCALRRRRTLTELYTRMPVLPEDQDVADERTRILAPSPDSLLHTPLIIKELSKVYEQRVPLLAVDRLSLAVQKGECFGLLGFNGAGKTTTFKMLTGEESLTSGDAFVGGHRISSDVGKVRQRIGYCPQFDALLDHMTGREMLVMYARLRGIPERHIGACVENTLRGLLLEPHANKLVRTYSGGNKRKLSTGIALIGEPAVIFLDEPSTGMDPVARRLLWDTVARARESGKAIIITSHSMEECEALCTRLAIMVQGQFKCLGSPQHLKSKFGSGYSLRAKVQSEGQQEALEEFKAFVDLTFPGSVLEDEHQGMVHYHLPGRDLSWAKVFGILEKAKEKYGVDDYSVSQISLEQVFLSFAHLQPPTAEEGR

SEQ ID NO: 214 - protein, 674 aa, Homo sapiens
MAAFSVGTAMNASSYSAEMTEPKSVCVSVDEVVSSNMEATETDLLNGHLKKVDNNLTEAQRFSSLPRRAAVNIEFRDLSYSVPEGPWWRKKGYKTLLKGISGKFNSGELVAIMGPSGAGKSTLMNILAGYRETGMKGAVLINGLPRDLRCFRKVSCYIMQDDMLLPHLTVQEAMMVSAHLKLQEKDEGRREMVKEILTALGLLSCANTRTGSLSGGQRKRLAIALELVNNPPVMFFDEPTSGLDSASCFQVVSLMKGLAQGGRSIICTIHQPSAKLFELFDQLYVLSQGQCVYRGKVCNLVPYLRDLGLNCPTYHNPADFVMEVASGEYGDQNSRLVRAVREGMCDSDHKRDLGGDAEVNPFLWHRPSEEVKQTKRLKGLRKDSSSMEGCHSFSASCLTQFCILFKRTFLSIMRDSVLTHLRITSHIGIGLLIGLLYLGIGNETKKVLSNSGFLFFSMLFLMFAALMPTVLTFPLEMGVFLREHLNYWYSLKAYYLAKTMADVPFQIMFPVAYCSIVYWMTSQPSDAVRFVLFAALGTMTSLVAQSLGLLIGAASTSLQVATFVGPVTAIPVLLFSGFFVSFDTIPTYLQWMSYISYVRYGFEGVILSIYGLDREDLHCDIDETCHFQKSEAILRELDVENAKLYLDFIVLGIFFISLRLIAYLVLRYKIRAER

SEQ ID NO: 215 - protein, 149 aa, Homo sapiens [sequence omitted]

SEQ ID NO: 216 - protein, 354 aa, Homo sapiens
MPRRSLHAAAVLLLVILKEQPSSPAPVNGSKWTYFGPDGENSWSKKYPSCGGLLQSPIDLHSDILQYDASLTPLEFQGYNLSANKQFLLTNNGHSVKLNLPSDMHIQGLQSRYSATQLHLHWGNPNDPHGSEHTVSGQHFAAELHIVHYNSDLYPDASTASNKSEGLAVLAVLIEMGSFNPSYDKIFSHLQHVKYKGQEAFVPGFNIEELLPERTAEYYRYRGSLTTPPCNPTVLWTVFRNPVQISQEQLLALETALYCTHMDDPSPREMINNFRQVQKFDERLVYTSFSQVQVCTAAGLSLGIILSLALAGILGICIVVVVSIWLFRRKSIKKGDNKGVIYKPATKMETEAHA

SEQ ID NO: 217 - protein, 244 aa, Homo sapiens
MELFLAGRRVLVTGAGKGIGRGTVQALHATGARVVAVSRTQADLDSLVRECPGIEPVCVDLGDWEATERALGSVGPVDLLVNNAAVALLQPFLEVTKEAFDRSFEVNLRAVIQVSQIVARGLIARGVPGAIVNVSSQCSQRAVTNHSVYCSTKGALDMLTKVMALELGPHKIRVNAVNPTVVMTSMGQATWSDPHKAKTMLNRIPLGKFAEVEHVVNAILFLLSDRSGMTTGSTLPVEGGFWAC

SEQ ID NO: 218 - protein, 756 aa, Homo sapiens
MAEAHQAVAFQFTVTPDGIDLRLSHEALRQIYLSGLHSWKKKFIRFKNGIITGVYPASPSSWLIVVVGVMTTMYAKIDPSLGIIAKINRTLETANCMSSQTKNVVSGVLFGTGLWVALIVTMRYSLKVLLSYHGWMFTEHGKMSRATKIWMGMVKIFSGRKPMLYSFQTSLPRLPVPAVKDTVNRYLQSVRPLMKEEDFKRMTALAQDFAVGLGPRLQWYLKLKSWWATNYVSDWWEEYIYLRGRGPLMVNSNYYAMDLLYILPTHIQAARAGNAIHAILLYRRKLDREEIKPIRLLGSTIPLCSAQWERMFNTSRIPGEETDTIQHMRDSKHIVVYHRGRYFKVWLYHDGRLLKPREMEQQMQRILDNTSEPQPGEARLAALTAGDRVPWARCRQAYFGRGKNKQSLDAVEKAAFFVTLDETEEGYRSEDPDTSMDSYAKSLLHGRCYDRWFDKSFTFVVFKNGKMGLNAEHSWADAPIVAHLWEYVMSIDSLQLGYAEDGHCKGDINPNIPYPTRLQWDIPGECQEVIETSLNTANLLANDVDFHSFPFVAFGKGIIKKCRTSPDAFVQLALQLAHYKDMGKFCLTYEASMTRLFREGRTETVRSCTTESCDFVRAMVDPAQTVEQRLKLFKLASEKHQHMYRLAMTGSGIDRHLFCLYVVSKYLAVESPFLKEVLSEPWRLSTSQTPQQQVELFDLENNPEYVSSGGGFGPVADDGYGVSYILVGENLINFHISSKFSCPETGIISQGPSSDT

SEQ ID NO: 219 - protein, 509 aa, Homo sapiens
MGCSAKARWAAGALGVAGLLCAVLGAVMIVMVPSLIKQQVLKNVRIDPSSLSFNMWKEIPIPFYLSVYFFDVMNPSEILKGEKPQVRERGPYVYRESRHKSNITFNNNDTVSFLEYRTFQFQPSKSHGSESDYIVMPNILVLGAAVMMENKPMTLKLIMTLAFTTLGERAFMNRTVGEIMWGYKDPLVNLINKYFPGMFPFKDKFGLFAELNNSDSGLFTVFTGVQNISRIHLVDKWNGLSKVDFWHSDQCNMINGTSGQMWPPFMTPESSLEFYSPEACRSMKLMYKESGVFEGIPTYRFVAPKTLFANGSIYPPNEGFCPCLESGIQNVSTCRFSAPLFLSHPHFLNADPVLAEAVTGLHPNQEAHSLFLDIHPVTGIPMNCSVKLQLSLYMKSVAGIGQTGKIEPVVLPLLWFAESGAMEGETLHTFYTQLVLMPKVMHYAQYVLLALGCVLLLVPVICQIRSQEKCYLFWSSSKKGSKDKEAIQAYSESLMTSAPKGSVLQEAKL

SEQ ID NO: 220 - protein, 199 aa, Homo sapiens
MHRKFVVQLFAEEWGQYVDLPKGFAVSERCKVRLVPLQIQLTTLGNLTPSSTVFFCCDMQERFRPAIKYFGDIISVGQRLLQGARILGIPVIVTEQYPKGLGSTVQEIDLTGVKLVLPKTKFSMVLPEVEAALAEIPGVRSVVLFGVETHVCIQQTALELVGRGVEVHIVADATSSRSMMDRMFARLTSRSNGDHSDHE

SEQ ID NO: 221 - protein, 283 aa, Homo sapiens
MTSGPGGPAAAAGGRKENHQWYVCNREKLCESLQAVFVQSYLDQGTQIFLNNSIEKSGWLFIQLYHSFVSSVFSLFMSRTSINGLLGRGSMFVFSPDQFQRLLKINPDWKTHRLLDLGAGDGEVTKIMSPHFEEIYATELSETMIWQLQKKKYRVLGINEWQNTGFQYDVISCLNLLDRCDQPLTLLKDIRSVLEPTRGRVILALVLPFHPYVENVGGKWEKPSEILEIKGQNWEEQVNSLPEVFRKAGFVIEAFTRLPYLCEGDMYNDYYVLDDAVFVLKPV

SEQ ID NO: 222 - protein, 220 aa, Homo sapiens
MSMGLEITGTALAVLGWLGTIVCCALPMWRVSAFIGSNIITSQNIWEGLWMNCVVQSTGQMQCKVYDSLLALPQDLQAARALIVVAILLAAFGLLVALVGAQCTNCVQDDTAKAKITIVAGVLFLLAALLTLVPVSWSANTIIRDFYNPVVPEAQKREMGAGLYVGWAAAALQLLGGALLCCSCPPREKKYTATKVVYSAPRSTGPGASLGTGYDRKDYV

SEQ ID NO: 223 - protein, 251 aa, Homo sapiens
MEGGAAAATPTALPYYVAFSQLLGLTLVAMTGAWLGLYRGGIAWESDLQFNAHPLCMVIGLIFLQGNALLVYRVFRNEAKRTTKVLHGLLHIFALVIALVGLVAVFDYHRKKGYADLYSLHSWCGILVFVLYFVQWLVGFSFFLFPGASFSLRSRYRPQHIFFGATIFLLPVGTALLGLKEALLFNLGGKYSAFEPEGVLANVLGLLLACFGGAVLYILTRADWKRPSQAEEQALSMDFKTLRQGDSPGSQ

SEQ ID NO: 224 - protein, 401 aa, Homo sapiens
YVCNCSVVGSLNVNRCNQTTGQCECRPGYQGLHCETCKEGFYLNYTSGLCQPCDCSPHGALSIPCNSSGKCQCKVGVIGSICDRCQDGYYGFSKNGCLPCQCNNRSASCDALTGACLNCQENSKGNHCEECKEGFYQSPDATKECLRCPCSAVTSTGSCSIKSSELEPECDQCKDGYIGPNCNKCENGYYNFDSICRKCQCHGHVDPVKTPKICKPESGECINCLHNTTGFWCENCLEGYVHDLEGNCIKKEVILPTPEGSTILVSNASLTTSVPTPVINSTFTPTTLQTIFSVSTSENSTSALADVSWTQFNIIILTVIIIVVVLLMGFVGAVYMYREYQNRKLNAPFWTIELKEDNISFSSYHDSIPNADVSGLLEDDGNEVAPNGQLTLTTPIHNYKA

SEQ ID NO: 225 - protein, 686 aa, Homo sapiens
MKPSWLQCRKVTSAGGLGGPLPGSSPARGAGAALRALVVPGPRGGLGGRGCRALSSGSGSEYKTHFAASVTDPERFWGKAAEQISWYKPWTKTLENKHSPSTRWFVEGMLNICYNAVDRHIENGKGDKIAIIYDSPVTNTKATFTYKEVLEQVSKLAGVLVKHGIKKGDTVVIYMPMIPQAMYTMLACARIGAIHSLIFGGFASKELSSRIDHVKPKVVVTASFGIEPGRRVEYVPLVEEALKIGQHKPDKILIYNRPNMEAVPLAPGRDLDWDEEMAKAQSHDCVPVLSEHPLYILYTSGTTGLPKGVIRPTGGYAVMLHWSMSSIYGLQPGEVWWAASDLGWVVGHSYICYGPLLHGNTTVLYEGKPVGTPDAGAYFRVLAEHGVAALFTAPTAIRAIRQQDPGAALGKQYSLTRFKTLFVAGERCDVETLEWSKNVFRVPVLDHWWQTETGSPITASCVGLGNSKTPPPGQAGKSVPGYNVMILDDNMQKLKARCLGNIVVKLPLPPGAFSGLWKNQEAFKHLYFEKFPGYYDTMDAGYMDEEGYLYVMSRVDDVINVAGHRISAGAIEESILSHGTVADCAVVGKEDPLKGHVPLALCVLRKDINATEEQVLEEIVKHVRQNIGPVAAFRNAVFVKQLPKTRSGKIPRSALSAIVNGKPYKITSTIEDPSIFGHVEEMLKQA

SEQ ID NO: 226 - protein, 225 aa, Homo sapiens
MAAAGGGGGGAAAAGRAYSFKVVLLGEGCVGKTSLVLRYCENKFNDKHITTLQASFLTKKLNIGGKRVNLAIWDTAGQERFHALGPIYYRDSNGAILVYDITDEDSFQKVKNWVKELRKMLGNEICLCIVGNKIDLEKERHVSIQEAESYAESVGAKHYHTSAKQNKGIEELFLDLCKRMIETAQVDERAKGNGSSQPGTARRGVQIIDDEPQAQTSGGGCCSSG

SEQ ID NO: 227 - protein, 380 aa, Homo sapiens
MGSTDSKLNFRKAVIQLTTKTQPVEATDDAFWDQFWADTATSVQDVFALVPAAEIRAVREESPSNLATLCYKAVEKLVQGAESGCHSEKEKQIVLNCSRLLTRVLPYIFEDPDWRGFFWSTVPGAGRGGGEEDDEHARPLAESLLLAIADLLFCPDFTVQSHRRSTVDSAEDVHSLDSCEYIWEAGVGFAHSPQPNYIHDMNRMELLKLLLTCFSEAMYLPPAPESGSTNPWVQFFCSTENRHALPLFTSLLNTVCAYDPVGYGIPYNHLLFSDYREPLVEEAAQVLIVTLDHDSASSASPTVDGTTTGTAMDDADPPGPENLFVNYLSRIHREEDFQFILKGIARLLSNLLLQKKKKKKKKKKKKKKKKKKKKKKKKKK

SEQ ID NO: 228 - protein, 144 aa, Homo sapiens
MCRVQTHGCHPLRSVTVRPDPSPAAPPPHPGPPRQLSQGAQACLAPQPSGNPARRPLQVGSGPQVAKQRQQQPRLTPCPSLWRPGTPAISTTWVRLSLSGSPARVPPGVLGHLRGSLMGQAGQSELRALSGWCPNLSTPHSFPP

SEQ ID NO: 229 - protein, 141 aa, Homo sapiens; identical to SEQ ID NO: 202

SEQ ID NO: 230 - protein, 161 aa, Homo sapiens
MSYLSGSSASPARRLGVVKVVPRPCLQWLENPGGCLGPSGQREAGSSSPGDCGHIGACLGLEGQVTSPATLPSLLWGPHFRATLPEAHASIHSFSALNLIHKQPPPFPFPSHSVDVILPPPVSILRQASKEALTLLPKWCFLKNTITTLGAIFSHLPVFRM

SEQ ID NO: 231 - protein, 132 aa, Homo sapiens
MRAINIADELPRSRARKLADEQLSSVIQDMAVRQHLLTNLVEVDGRFVWRVNLDALTQHLDKILAFPQRQESYLGPTLFLLGGNSQFVHPSHHPEIMRLFPRAQMQTVPNAGHWIHADRPQDFIAAIRGFLV

SEQ ID NO: 232 - protein, 328 aa, Homo sapiens
MLPRVGCPALPLPPPPLLPLLPLLLLLLGASGGGGGARAEVLFRCPPCTPERLAACGPPPVAPPAAVAAVAGGARMPCAELVREPGCGCCSVCARLEGEACGVYTPRCGQGLRCYPHPGSELPLQALVMGEGTCEKRRDAEYGASPEQVADNGDDHSEGGLVENHVDSTMNMLGGGGSAGRKPLKSGMKELAVFREKVTEQHRQMGKGGKHHLGLEEPKKLRPPPARTPCQQELDQVLERISTMRLPDERGPLEHLYSLHIPNCDKHGLYNLKQCKMSLNGQRGECWCVNPNTGKLIQGAPTIRGDPECHLFYNEQQEACGVHTQRMQ

SEQ ID NO: 233 - protein, 417 aa, Homo sapiens
MAVETTVHTHLSASPPQGSPYDHTPGMAGSLGYHPYAAPLGSYPYGDPAYRKNATRDATATLKAWLNEHRKNPYPTKGEKIMLAIITKMTLTQVSTWFANARRRLKKENKMTWTPRNRSEDEEEEENIDLEKNDEDEPQKPEDKGDPEGPEAGGAEQKAASGCERLQGPPTPAGKETEGSLSDSDFKEPPSEGRLDALQGPPRTGGPSPAGPAAARLAEDPAPHYPAGAPAPGPHPAAGEVPPGPGGPSVIHSPPPPPPPAVLAKPKLWSLAEIATLSDKVKDGGGGNEGSPCPPCPGPIAGQALGGSRASPAPAPSRSPSAQCPFPGGTVLSRPLYYTAPFYPGYTNYGSFGHLHGHPGPGPGPTTGPGSHFNGLNQTVLNRADALAKDPKMLRSQSQLDLCKDSPYELKKGMSDI

SEQ ID NO: 234 - protein, 257 aa, Homo sapiens
MSGHKCSYPWDLQDRYAQDKSVVNKMQQKYWETKQAFIKATGKKEDEHVVASDADLDAKLELFHSIQRTCLDLSKAIVLYQKRICFLSQEENELGKFLRSQGFQDKTRAGKMMQATGKALCFSSQQRLALRNPLCRFHQEVETFRHRAISDTWLTVNRMEQCRTEYRGALLWMKDVSQELDPDLYKQMEKFRKVQTQVRLAKKNFDKLKMDVCQKVDLLGASRCNLLSHMLATYQLAWDQWQGPRNLKVLTKMTCCC

SEQ ID NO: 235 - protein, 395 aa, Homo sapiens [sequence omitted]

SEQ ID NO: 236 - protein, 351 aa, Homo sapiens
MAAAPLKVCIVGSGNWGSAVAKIIGNNVKKLQKFASTVKMWVFEETVNGRKLTDIINNDHENVKYLPGHKLPENVVAMSNLSEAVQDADLLVFVIPHQFIHRICDEITGRVPKKALGITLIKGIDEGPEGLKLISDIIREKMGIDISVLMGANIANEVAAEKFCETTIGSKVMENGLLFKELLQTPNFRITVVDDADTVELCGALKNIVAVGAGFCDGLRCGDNTKAAVIRLGLMEMIAFARIFCKGQVSTATFLESCGVADLITTCYGGRNRRVAEAFARTGKTIEELEKEMLNGQKLQGPQTSAEVYRILKQKGLLDKFPLFTAVYQICYESRPVQEMLSCLQSHPEHT

SEQ ID NO: 237 - protein, 871 aa, Homo sapiens
MDLKLRAASPIITLVALDEALDNYTITFLIRGVAIGQTSLTASVTNKAGQRINSAPQQIEVFPPFRLMPRKVTLLIGATMQVTSEGGPQPQSNILFSISNESVALVSAAGLVQGLAIGNGTVSGLVQAVDAETGKVVIISQDLVQVEVLLLRAVRIRAPIMRMRTGTQMPIYVTGITNHQNPFSFGNAVPGLTFHWSVTKRDVLDLRGRHHEASIRLPSQYNFAMNVLGRVKGRTGLRVVVKAVDPTSGQLYGLARELSDEIQVQVFEKLQLLNPEIEAEQILMSPNSYIKLQTNRDGAASLSYRVLDGPEKVPVVHVDEKGFLASGSMIGTSTIEVIAQEPFGANQTIIVAVKVSPVSYLRVSMSPVLHTQNKEALVAVPLGMTVTFTVHFHDNSGDVFHAHSSVLNFATNRDDFVQIGKGPTNNTCVVRTVSVGLTLLRVWDAEHPGLSDFMPLPVLQAISPELSGAMVVGDVLCLATVLTSLEGLSGTWSSSANSILHIDPKTGVAVARAVGSVTVYYEVAGHLRTYKEVVVSVPQRIMARHLHPIQTSFQEATASKVIVAVGDRSSNLRGECTPTQREVIQALHPETLISCQSQFKPAVFDFPSQDVFTVEPQFDTALGQYFCSITMHRLTDKQRKHLSMKKTALVVSASLSSSHFSTEQVGAEVPFSPGLFADQAEILLSNHYTSSEIRVFGAPEVLENLEVKSGSPAVLAFAKEKSFGWPSFITYTVGVLDPAAGSQGPLSTTLTFSSPVTNQAIAIPVTVAFVVDRRGPGPYGASLFQHFLDSYQVMFFTLFALLAGTAVMIIAYHTVCTPRDLAVPAALTPRASPGHSPHYFAASSPTSPNALPPARKASPPSGLWSPAYASH

SEQ ID NO: 238 - protein, 728 aa, Homo sapiens
LPACRLCHRREHGRTVCSGVDTKLKFTLEPSLGQNGFQQWYDALKAVARLSTGIPKEWRRKVWLTLADHYLHSIAIDWDKTMRFTFNERSNPDDDSMGIQIVKDLHRTGCSSYCGQEAEQDRVVLKRVLLAYARWNKTVGYCQGFNILAALILEVMEGNEGDALKIMIYLIDKVLPESYFVNNLRALSVDMAVFRDLLRMKLPELSQHLDTLQRTANKESGGGYEPPLTNVFTMQWFLTLFATCLPNQTVLKIWDSVFFEGSEIILRVSLAIWAKLGEQIECCETADEFYSTMGRLTQEMLENDLLQSHELMQTVYSMAPFPFPQLAELREKYTYNITPFPATVKPTSVSGRHSKARDSDEENDPDDEDAVVNAVGCLGPFSGFLAPELQKYQKQIKEPNEEQSLRSNNIAELSPGAINSCRSEYHAAFNSMMMERMTTDINALKRQYSRIKKKQQQQVHQVYIRADKGPVTSILPSQVNSSPVINHLLLGKKMKMTNRAAKNAVIHIPGHTGGKISPVPYEDLKTKLNSPWRTHIRVHKKNMPRTKSHPGCGDTVGLIDEQNEASKTNGLGAAEAFPSGCTATAGREGSSPEGSTRRTIEGQSPEPVFGDADVDVSAVQAKLGALELNQRDAAAETELRVHPPCQRHCPEPPSAPEENKATSKAPQGSNSKTPIFSPFPSVKPLRKSATARNLGLYGPTERTPTVHFPQMSRSFSKPGGGNSGTKKR

SEQ ID NO: 239 - protein, 787 aa, Homo sapiens
DLYLLLLSYSDKKDHLTVEELAQFLKVEQKMNNVTTDYCLDIIKKFEVSEENKVKNVLGIEGFTNFMRSPACDIFNPLHHEVYQDMDQPLCNYYIASSHNTYLTGDQLLSQSKVDMYARVLQEGCRCVEVDCWDGPDGEPVVHHGYTLTSKILFRDVVETINKHAFVKNEFPVILSIENHCSIQQQRKIAQYLKGIFGDKLDLSSVDTGECKQLPSPQSLKGKILVKGKKLPYHLGDDAEEGEVSDEDSADEIEDECKFKLHYSNGTTEHQVESFIRKKLESLLKESQIRDKEDPDSFTVRALLKATHEGLNAHLKQSPDVKESGKKSHGRSLMTNFGKHKKTTKSRSKSYSTDDEEDTQQSTGKEGGQLYRLGRRRKTMKLCRELSDLVVYTNSVAAQDIVDDGTTGNVLSFSETRAHQVVQQKSEQFMIYNQKQLTRIYPSAYRIDSSNFNPLPYWNAGCQLVALNYQSEGRMMQLNRAKFKANGNCGYVLKPQQMCKGTFNPFSGDPLPANPKKQLILKVISGQQLPKPPDSMFGDRGEIIDPFVEVEIIGLPVDCCKDQTRVVDDNGFNPVWEETLTFTVHMPEIALVRFLVWDHDPIGRDFVGQRTVTFSSLVPGYRHVYLEGLTEASIFVHITINEIYGKWSPLILNPSYTILHFLGATKNRQLQGLKGLFNKNPRHSSSENNSHYVRKRSIGDRILRRTASAPAKGRKKSKMGFQEMVEIKDSVSEATRDQDGVLRRTTRSLQARPVSMPVDRNLLGALSLPVSETAKDIEGKENSLVQI

SEQ ID NO: 240 - protein, 665 aa, Homo sapiens
MAHEMIGTQIVTERLVALLESGTEKVLLIDSRPFVEYNTSHILEAININCSKLMKRRLQQDKVLITELIQHSAKHKVDIDCSQKVVVYDQSSQDVASLSSDCFLTVLLGKLEKSFNSVHLLAGGFAEFSRCFPGLCEGKSTLVPTCISQPCLPVANIGPTRILPNLYLGCQRDVLNKELMQQNGIGYVLNASNTCPKPDFIPESHFLRVPVNDSFCEKILPWLDKSVDFIEKAKASNGCVLVHCLAGISRSATIAIAYIMKRMDMSLDEAYRFVKEKRPTISPNFNFLGQLLDYEKKIKNQTGASGPKSKLKLLHLEKPNEPVPAVSEGGQKSETPLSPPCADSATSEAAGQRPVHPASVPSVPSVQPSLLEDSPLVQALSGLHLSADRLEDSNKLKRSFSLDIKSVSYSASMAASLHGFSSSEDALEYYKPSTTLDGTNKLCQFSPVQELSEQTPETSPDKEEASIPKKLQTARPSDSQSKRLHSVRTSSSGTAQRSLLSPLHRSGSVEDNYHTSFLFGLSTSQQHLTKSAGLGLKGWHSDILAPQTSTPSLTSSWYFATESSHFYSASAIYGGSASYSAYSCSQLPTCGDQVYSVRRRQKPSDRADSRRSWHEESPFEKQFKRRSCQMEFGESIMSENRSREELGKVGSQSSFSGSMEIIEVS

SEQ ID NO: 241 - protein, 563 aa, Homo sapiens
MWAVLRLALRPCARASPAGPRAYHGDSVASLGTQPDLGSALYQENYKQMKALVNQLHERVEHIKLGGGEKARALHISRGKLLPRERIDNLIDPGSPFLELSQFAGYQLYDNEEVPGGGIITGIGRVSGVECMIIANDATVKGGAYYPVTVKKQLRAQEIAMQNRLPCIYLVDSGGAYLPRQADVFPDRDHFGRTFYNQAIMSSKNIAQIAVVMGSCTAGGAYVPAMADENIIVRKQGTIFLAGPPLVKAATGEEVSAEDLGGADLHCRKSGVSDHWALDDHHALHLTRKVVRNLNYQKKLDVTIEPSEEPLFPADELYGIVGANLKRSFDVREVIARIVDGSRFTEFKAFYGDTLVTGFARIFGYPVGIVGNNGVLFSESAKKGTHFVQLCCQRNIPLLFLQNITGFMVGREYEAEGIAKDGAKMVAAVACAQVPKITLIIGGSYGAGNYGMCGRAYSPRFLYIWPNARISVMGGEQAANVLATITKDQRAREGKQFSSADEAALKEPIIKKFEEEGNPYYSSARVWDDGIIDPADTRLVLGLSFSAALNAPIEKTDFGIFRM

SEQ ID NO: 242 - protein, 758 aa, Homo sapiens
MAEPRQEFEVMEDHAGTYGLGDRKDQGGYTMHQDQEGDTDAGLKESPLQTPTEDGSEEPGSETSDAKSTPTAEDVTAPLVDEGAPGKQAAAQPHTEIPEGTTAEEAGIGDTPSLEDEAAGHVTQEPESGKVVQEGFLREPGPPGLSHQLMSGMPGAPLLPEGPREATRQPSGTGPEDTEGGRHAPELLKHQLLGDLHQEGPPLKGAGGKERPGSKEEVDEDRDVDESSPQDSPPSKASPAQDGRPPQTAAREATSIPGFPAEGAIPLPVDFLSKVSTEIPASEPDGPSVGRAKGQDAPLEFTFHVEITPNVQKEQAHSEEHLGRAAFPGAPGEGPEARGPSLGEDTKEADLPEPSEKQPAAAPRGKPVSRVPQLKARMVSKSKDGTGSDDKKAKTSTRSSAKTLKNRPCLSPKLPTPGSSDPLIQPSSPAVCPEPPSSPKHVSSVTSRTGSSGAKEMKLKGADGKTKIATPRGAAPPGQKGQANATRIPAKTPPAPKTPPSSGEPPKSGDRSGYSSPGSPGTPGSRSRTPSLPTPPTREPKKVAVVRTPPKSPSSAKSRLQTAPVPMPDLKNVKSKIGSTENLKHQPGGGKVQIINKKLDLSNVQSKCGSKDNIKHVPGGGSVQIVYKPVDLSKVTSKCGSLGNIHHKPGGGQVEVKSEKLDFKDRVQSKIGSLDNITHVPGGGNKKIETHKLTFRENAKAKTDHGAEIVYKSPVVSGDTSPRHLSNVSSTGSIDMVDSPQLATLADEVSASLAKQGL

SEQ ID NO: 243 - protein, 547 aa, Homo sapiens
MENDESAKEEKSDLKEKSTGSKKANRFHPYSKDKNSGTGEKKGPNRNRVFISNIPYDMKWQAIKDLMREKVGEVTYVELFKDAEGKSRGCGVVEFKDEEFVKKALETMNKYDLSGRRVNIKEDPDGENARRALQRTGTSFQGSHASDVGSGLVNLPPSILNNPNIPPEVISNLQAGRLGSTIFVANLDFKVGWKKLKEVFSIAGTVKAGSYKEDKDGKSRGMGTVTFEQAIEAVQAISMFNGQFLFDRPMHVKMDDKSVPHEEYRSPDGKTPQLPRGLGGIGMGLGPGGQPISASQLNIGGVMGNLGPGGMGMDGPGFGGMNRIGGGIGFGGLEAMNSMGGFGGVGRMGELYRGAMTSSMERDFGHRDIGLSRGFGDSFGRLGSAMIGGITGRIGSSNMGPVGSGISGGMGSMNSVTGGMGMGLDRMSSSFDRMGPGIGAILERSIDMDRGFLSGPMGSGMRERIGSKGNQIFVRNLPFDLTWQKLKEKFSQCGHVMFAEIKMENGKSKGCGTVRFDSPESAEKACRIMNGIKISGREIDVRLDRNA

SEQ ID NO: 244 - protein, 1022 aa, Homo sapiens [sequence omitted]

SEQ ID NO: 245 - protein, 335 aa, Homo sapiens
MGSASPGLSSVSPSHLLLPPDTVSRTGLEKAAAGAVGLERRDWSPSPPATPEQGLSAFYLSYFDMLYPEDSSWAAKAPGASSREEPPEEPEQCPVIDSQAPAGSLDLVPGGLTLEEHSLEQVQSMVVGEVLKDIETACKLLNITADPMDWSPSNVQKWLLWTEHQYRLPPMGKAFQELAGKELCAMSEEQFRQRSPLGGDVLHAHLDIWKSAAWMKERTSPGAIHYCASTSEESWTDSEVDSSCSGQPIHLWQFLKELLLKPHSYGRFIRWLNKEKGIFKIEDSAQVARLWGIRKNRPAMNYDKLSRSIRQYYKKGIIRKPDISQRLVYQFVHPI

SEQ ID NO: 246 - protein, 174 aa, Homo sapiens
MAAAMVPGRSESWERGEPGRPALYFCGSIRGGREDRTLYERIVSRLRRFGTVLTEHVAAAELGARGEEAAGGDRLIHEQDLEWLQQADVVVAEVTQPSLGVGYELGRAVAFNKRILCLFRPQSGRVLSAMIRGAADGSRFQVWDYEEGEVEALLDRYFEADPPGQVAASPDPTT

SEQ ID NO: 247 - protein, 665 aa, Homo sapiens; identical to SEQ ID NO: 240

SEQ ID NO: 248 - protein, 301 aa, Homo sapiens
MKSNPAIQAAIDLTAGAAGGTACVLTGQPFDTMKVKMQTFPDLYRGLTDCCLKTYSQVGFRGFYKGTSPALIANIAENSVLFMCYGFCQQVVRKVAGLDKQAKLSDLQNAAAGSFASAFAALVLCPTELVKCRLQTMYEMETSGKIAKSQNTVWSVIKSILRKDGPLGFYHGLSSTLLREVPGYFFFFGGYELSRSFFASGRSKDELGPVPLMLSGGVGGICLWLAVYPVDCIKSRIQVLSMSGKQAGFIRTFINVVKNEGITALYSGLKPTMIRAFPANGALFLAYEYSRKLMMNQLEAY

SEQ ID NO: 249 - protein, 337 aa, Homo sapiens
MAAPRDNVTLLFKLYCLAVMTLMAAVYTIALRYTRTSDKELYFSTTAVCITEVIKLLLSVGILAKETGSLGRFKASLRENVLGSPKELLKLSVPSLVYAVQNNMAFLALSNLDAAVYQVTYQLKIPCTALCTVLMLNRTLSKLQWVSVFMLCAGVTLVQWKPAQATKVVVEQNPLLGFGAIAIAVLCSGFAGVYFEKVLKSSDTSLWVRNIQMYLSGIIVTLAGVYLSDGAEIKEKGFFYGYTYYVWFVIFLASVGGLYTSVVVKYTDNIMKGFSAAAAIVLSTIASVMLFGLQITLTFALGTLLVCVSIYLYGLPRQDTTSIQQGETASKERVIGV

SEQ ID NO: 250 - protein, 487 aa, Homo sapiens
MMHFKSGLELTELQNMTVPEDDNISNDSNDFTEVENGQINSKFISDRESRRSLTNSHLEKKKCDEYIPGTTSLGMSVFNLSNAIMGSGILGLAFALANTGILLFLVLLTSVTLLSIYSINLLLICSKETGCMVYEKLGEQVFGTTGKFVIFGATSLQNTGAMLSYLFIVKNELPSAIKFLMGKEETFSAWYVDGRVLVVIVTFGIILPLCLLKNLGYLGYTSGFSLSCMVFFLIVVIYKKFQIPCIVPELNSTISANSTNADTCTPKYVTFNSKTVYALPTIAFAFVCHPSVLPIYSELKDRSQKKMQMVSNISFFAMFVMYFLTAIFGYLTFYDNVQSDLLHKYQSKDDILILTVRLAVIVAVILTVPVLFFTVRSSLFELAKKTKFNLCRHTVVTCILLVVINLLVIFIPSMKDIFGVVGVTSANMLIFILPSSLYLKITDQDGDKGTQRIWAALFLGLGVLFSLVSIPLVIYDWACSSSSDEGH

SEQ ID NO: 251 - protein, 528 aa, Homo sapiens
MAGSDTAPFLSQADDPDDGPVPGTPGLPGSTGNPKSEEPEVPDQEGLQRITGLSPGRSALIVAVLCYINLLNYMDRFTVAGVLPDIEQFFNIGDSSSGLIQTVFISSYMVLAPVFGYLGDRYNRKYLMCGGIAFWSLVTLGSSFIPGEHFWLLLLTRGLVGVGEASYSTIAPTLIADLFVADQRSRMLSIFYFAIPVGSGLGYIAGSKVKDMAGDWHWALRVTPGLGVVAVLLLFLVVREPPRGAVERHSDLPPLNPTSWWADLRALARNPSFVLSSLGFTAVAFVTGSLALWAPAFLLRSRVVLGETPPCLPGDSCSSSDSLIFGLITCLTGVLGVGLGVEISRRLRHSNPRADPLVCATGLLGSAPFLFLSLACARGSIVATYIFIFIGETLLSMNWAIVADILLYVVIPTRRSTAEAFQIVLSHLLGDAGSPYLIGLISDRLRRNWPPSFLSEFRALQFSLMLCAFVGALGGAAFLGTAIFIEADRRRAQLHVQGLLHEAGSTDDRIVVPQRGRSTRVPVASVLI

SEQ ID NO: 252 - protein, 418 aa, Homo sapiens [sequence omitted]

SEQ ID NO: 253 - protein, 1281 aa, Homo sapiens
MVRKKNPPLRNVASEGEGQILEPIGTESKVSGKNKEFSADQMSENTDQSDAAELNHKEEHSLHVQDPSSSSKKDLKSAVLSEKAGFNYESPSKGGNFPSFPHDEVTDRNMLAFSSPAAGGVCEPLKSPQRAEADDPQDMACTPSGDSLETKEDQKMSPKATEETGQAQSGQANCQGLSPVSVASKNPQVPSDGGVRLNKSKTDLLVNDNPDPAPLSPELQDFKCNICGYGYYGNDPTDLIKHFRKYHLGLHNRTRQDAELDSKILALHNMVQFSHSKDFQKVNRSVFSGVLQDINSSRPVLLNGTYDVQVTSGGTFIGIGRKTPDCQGNTKYFRCKFCNFTYMGNSSTELEQHFLQTHPNKIKASLPSSEVAKPSEKNSNKSIPALQSSDSGDLGKWQDKITVKAGDDTPVGYSVPIKPLDSSRQNGTEATSYYWCKFCSFSCESSSSLKLLEHYGKQHGAVQSGGLNPELNDKLSRGSVINQNDLAKSSEGETMTKTDKSSSGAKKKDFSSKGAEDNMVTSYNCQFCDFRYSKSHGPDVIVVGPLLRHYQQLHNIHKCTIKHCPFCPRGLCSPEKHLGEITYPFACRKSNCSHCALLLLHLSPGAAGSSRVKHQCHQCSFTTPDVDVLLFHYESVHESQASDVKQEANHLQGSDGQQSVKESKEHSCTKCDFITQVEEEISRHYRRAHSCYKCRQCSFTAADTQSLLEHFNTVHCQEQDITTANGEEDGHAISTIKEEPKIDFRVYNLLTPDSKMGEPVSESVVKREKLEEKDGLKEKVWTESSSDDLRNVTWRGADILRGSPSYTQASLGLLTPVSGTQEQTKTLRDSPNVEAAHLARPIYGLAVETKGFLQGAPAGGEKSGALPQQYPASGENKSKDESQSLLRRRRGSGVFCANCLTTKTSLWRKNANGGYVCNACGLYQKLHSTPRPLNIIKQNNGEQIIRRRTRKRLNPEALQAEQLNKQQRGSNEEQVNGSPLERRSEDHLTESHQREIPLPSLSKYEAQGSLTKSHSAQQPVLVSQTLDIHKRMQPLHIQIKSPQESTGDPGNSSSVSEGKGSSERGSPIEKYMRPAKHPNYSPPGSPIEKYQYPLFGLPFVHNDFQSEADWLRFWSKYKLSVPGNPHYLSHVPGLPNPCQNYVPYPTFNLPPHFSAVGSDNDIPLDLAIKHSRPGPTANGASKEKTKAPPNVKNEGPLNVVKTEKVDRSTQDELSTKCVHCGIVFLDEVMYALHMSCHGDSGPFQCSICQHLCTDKYDFTTHIQRGLHRNNAQVEKNGKPKE

SEQ ID NO: 254 - protein, 822 aa, Homo sapiens
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKHSGINSSNAEVLALFNVTEADAGEYICKVSNYIGQANQSAWLTVLPKQQAPGREKEITASPDYLEIAIYCIGVFLIACMVVTVILCRMKNTTKKPDFSSQPAVHKLTKRIPLRRQVTVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEEYLDLSQPLEQYSPSYPDTRSSCSSGDDSVFSPDPMPYEPCLPQYPHINGSVKT

SEQ ID NO: 255 - protein, 167 aa, Homo sapiens
MLVLLAFIIAFHITSAALLFIATVDNAWWVGDEFFADVWRICTNNTNCTVINDSFQEYSTLQAVQATMILSTILCCIAFFIFVLQLFRLKQGERFVLTSIIQLMSCLCVMIAASIYTDRREDIHDKNAKFYPVTREGSYGYSYILAWVAFACTFISGMMYLILRKRK

SEQ ID NO: 256 - protein, 38 aa, Homo sapiens
MSEFWHKLGCCVVEKPQPVSLPTPHPNPKSSQLLCAVR

SEQ ID NO: 257 - DNA, 21 bp, Homo sapiens
tcctcacactaagagggcaga

SEQ ID NO: 258 - DNA, 21 bp, Homo sapiens
acctcaacacaaccaagcatc

SEQ ID NO: 259 - DNA, 21 bp, Homo sapiens
tcagtgagtacaacgccacag

SEQ ID NO: 260 - DNA, 21 bp, Homo sapiens
cttctcctggatgcttgtctg

SEQ ID NO: 261 - DNA, 21 bp, Homo sapiens
ccaccttcactgtgacgaaat

SEQ ID NO: 262 - DNA, 21 bp, Homo sapiens
ccagatgtgcaggaaagagag

SEQ ID NO: 263 - DNA, 21 bp, Homo sapiens
agctgtctgcacatctggatt

SEQ ID NO: 264 - DNA, 21 bp, Homo sapiens
cctggggtccaagtattcaat

SEQ ID NO: 265 - DNA, 21 bp, Homo sapiens
catcaagccatgaaaggtgtt

SEQ ID NO: 266 - DNA, 21 bp, Homo sapiens
acaaagagccaccaggatttt

SEQ ID NO: 267 - DNA, 21 bp, Homo sapiens
gaactgatgttcccaagtgga

SEQ ID NO: 268 - DNA, 21 bp, Homo sapiens
aaccaggttcaggaaagcatt

SEQ ID NO: 269 - DNA, 20 bp, Homo sapiens
tttcgtgaacaagcacctga

SEQ ID NO: 270 - DNA, 20 bp, Homo sapiens
atgagctcaaaggcaaagga

SEQ ID NO: 271 - DNA, 21 bp, Homo sapiens
gtttaaaatccggattggcat

SEQ ID NO: 272 - DNA, 21 bp, Homo sapiens
gtggccgtgataatttttgaa

SEQ ID NO: 273 - DNA, 21 bp, Homo sapiens
aaaatggaaggaaattgggtg

SEQ ID NO: 274 - DNA, 21 bp, Homo sapiens
tgcccagaataccaatgtctc

SEQ ID NO: 275 - DNA, 20 bp, Homo sapiens
tcggtgaattcaaggaccat

SEQ ID NO: 276 - DNA, 20 bp, Homo sapiens
gctgccttcaaggatctcac

SEQ ID NO: 277 - DNA, 20 bp, Homo sapiens
tgccaggtaaagctctgtcc

SEQ ID NO: 278 - DNA, 20 bp, Homo sapiens
gtcctgtggatgagcatgtg

SEQ ID NO: 279 - DNA, 21 bp, Homo sapiens
atctccagagctcgctttacc

SEQ ID NO: 280 - DNA, 21 bp, Homo sapiens
ttcacccgtaaggcactaatg

SEQ ID NO: 281 - DNA, 21 bp, Homo sapiens
tatggttatgtggatgcagca

SEQ ID NO: 282 - DNA, 21 bp, Homo sapiens
agatgactcgatggtccacac

SEQ ID NO: 283 - DNA, 20 bp, Homo sapiens
ccgagtaagccaaaaaccaa

SEQ ID NO: 284 - DNA, 20 bp, Homo sapiens
ctcatccatgggcctgtagt

SEQ ID NO: 285 - DNA, 21 bp, Homo sapiens
ggtgaggaactttcaccaaca

SEQ ID NO: 286 - DNA, 21 bp, Homo sapiens
cttgagtcctggcttgttgag

SEQ ID NO: 287 - DNA, 21 bp, Homo sapiens
tacttgggtgagtccttgtgg

SEQ ID NO: 288 - DNA, 21 bp, Homo sapiens
gactcttaggcctgtggctct

SEQ ID NO: 289 - DNA, 21 bp, Homo sapiens
ggagtaaggtgtccgaggaac

SEQ ID NO: 290 - DNA, 21 bp, Homo sapiens
ctgacatttggccactgtttt

SEQ ID NO: 291 - DNA, 21 bp, Homo sapiens
cctgtaacatagcccgaaaca

SEQ ID NO: 292 - DNA, 21 bp, Homo sapiens
agttgtctccatccacacagg

SEQ ID NO: 293 - DNA, 21 bp, Homo sapiens
acgtgtatgcagatggaaagg

SEQ ID NO: 294 - DNA, 21 bp, Homo sapiens
cagaggctgtgacgttgtgta

SEQ ID NO: 295 - DNA, 21 bp, Homo sapiens
aatttgtgcagttgggagatg

SEQ ID NO: 296 - DNA, 21 bp, Homo sapiens
tgatctctaccctgcagctgt

SEQ ID NO: 297 - DNA, 21 bp, Homo sapiens
catctgacttcacctgtgggt

SEQ ID NO: 298 - DNA, 21 bp, Homo sapiens
ttctgactgtccctgctgact

SEQ ID NO: 299 - DNA, 21 bp, Homo sapiens
accccgacgtcttctacctaa

SEQ ID NO: 300 - DNA, 21 bp, Homo sapiens
gcagataggcatcaaacacgt

SEQ ID NO: 301 - DNA, 21 bp, Homo sapiens
agttccctgggcataatgagt

SEQ ID NO: 302 - DNA, 21 bp, Homo sapiens
aacatgagagcttgggatcct

SEQ ID NO: 303 - DNA, 20 bp, Homo sapiens
agccgaatccactctcatgt

SEQ ID NO: 304 - DNA, 20 bp, Homo sapiens
taacaaggcacagcaagcag

SEQ ID NO: 305 - DNA, 21 bp, Homo sapiens
ctcagacctttgcccttctct

SEQ ID NO: 306 - DNA, 21 bp, Homo sapiens
tccggctcagactgaataaga

SEQ ID NO: 307 - DNA, 20 bp, Homo sapiens
cacacatgggcatttgctta

SEQ ID NO: 308 - DNA, 20 bp, Homo sapiens
ggatatgcagtgggaaggaa

SEQ ID NO: 309 - DNA, 21 bp, Homo sapiens
caccgagaatccttacaccaa

SEQ ID NO: 310 - DNA, 21 bp, Homo sapiens
cagaatccatcctccttcctc

SEQ ID NO: 311 - DNA, 21 bp, Homo sapiens
catgcacacacacacagaatg

SEQ ID NO: 312 - DNA, 21 bp, Homo sapiens
tttcctttggaaactgggatt

SEQ ID NO: 313 - DNA, 21 bp, Homo sapiens
cttgctgaattcaactctgcc

SEQ ID NO: 314 - DNA, 21 bp, Homo sapiens
aaaccacagagtggtcattgc

SEQ ID NO: 315 - DNA, 21 bp, Homo sapiens
aggagaaggaagacaagccag

SEQ ID NO: 316 - DNA, 21 bp, Homo sapiens
cttgctgatttcgtcttcagg

SEQ ID NO: 317 - DNA, 21 bp, Homo sapiens
ctgcttgagactgttctggct

SEQ ID NO: 318 - DNA, 21 bp, Homo sapiens
gattagagggcttcctcatgg

SEQ ID NO: 319 - DNA, 21 bp, Homo sapiens
caaggggaagaggtacctgac

SEQ ID NO: 320 - DNA, 21 bp, Homo sapiens
tctgtcacagcgagaatcctt

SEQ ID NO: 321 - DNA, 20 bp, Homo sapiens
gactctgggcgtctctgaag

SEQ ID NO: 322 - DNA, 20 bp, Homo sapiens
cagcaacaagccagtctcaa

SEQ ID NO: 323 - DNA, 21 bp, Homo sapiens
acatcatgagttggtccttgc

SEQ ID NO: 324 - DNA, 21 bp, Homo sapiens
aatctgcaatgccacaggtag

SEQ ID NO: 325 - DNA, 20 bp, Homo sapiens
tcctcatacatggcctcaca

SEQ ID NO: 326 - DNA, 20 bp, Homo sapiens
tgtcggcaccactcataaaa

SEQ ID NO: 327 - DNA, 20 bp, Homo sapiens
ggtgcaggttgacactgaaa

SEQ ID NO: 328 - DNA, 20 bp, Homo sapiens
aaggttcaccaggacacagg

SEQ ID NO: 329 - DNA, 21 bp, Homo sapiens
atcacaggcatcatcatcctc

SEQ ID NO: 330 - DNA, 21 bp, Homo sapiens
ggttgtcagctcctgtttctg

SEQ ID NO: 331 - DNA, 20 bp, Homo sapiens
ggggtgtaggtgggagtcac

SEQ ID NO: 332 - DNA, 20 bp, Homo sapiens
agtgccttcagccaaaatgt

SEQ ID NO: 333 - DNA, 21 bp, Homo sapiens
gccatcctcttgataagctga

SEQ ID NO: 334 - DNA, 21 bp, Homo sapiens
tcttcccaggattctctttgg

SEQ ID NO: 335 - DNA, 21 bp, Homo sapiens
gattgcagatcctatgcagga

SEQ ID NO: 336 - DNA, 21 bp, Homo sapiens
gcatccaggacaacacaaagt

SEQ ID NO: 337 - DNA, 20 bp, Homo sapiens
aaggtggagcaaacacaacc

SEQ ID NO: 338 - DNA, 20 bp, Homo sapiens
tccacttggctttctgtcct

SEQ ID NO: 339 - DNA, 21 bp, Homo sapiens
caagtgcccatttaggtttga

SEQ ID NO: 340 - DNA, 21 bp, Homo sapiens
actgacagatggctcatttgg

SEQ ID NO: 341 - DNA, 21 bp, Homo sapiens
gaacaccagagacactcctgc

SEQ ID NO: 342 - DNA, 21 bp, Homo sapiens
acatcctggtaggtgatgcag

SEQ ID NO: 343 - DNA, 20 bp, Homo sapiens
cgcatctgtccagcatctta

SEQ ID NO: 344 - DNA, 19 bp, Homo sapiens
caaaaccgggacgctaact

SEQ ID NO: 345 - DNA, 21 bp, Homo sapiens
agaaacagtggatcacgttgg

SEQ ID NO: 346 - DNA, 21 bp, Homo sapiens
ttccaagggaatacccaaaac

SEQ ID NO: 347 - DNA, 20 bp, Homo sapiens
gtttccacttttcccagtgc

SEQ ID NO: 348 - DNA, 22 bp, Homo sapiens
tcacatgaaacgattctctgct

SEQ ID NO: 349 - DNA, 21 bp, Homo sapiens
aatgtcaaaagtgtgggcaag

SEQ ID NO: 350 - DNA, 21 bp, Homo sapiens
atgtggaccgagtaaaggctt

SEQ ID NO: 351 - DNA, 21 bp, Homo sapiens
cagtcccgggtagatatccat

SEQ ID NO: 352 - DNA, 21 bp, Homo sapiens
tcttcggctagtttggtctca

SEQ ID NO: 353 - DNA, 21 bp, Homo sapiens
tgatttgccacagttggtgta

SEQ ID NO: 354 - DNA, 21 bp, Homo sapiens
ctaggtatgcgtctctgcagg

SEQ ID NO: 355 - DNA, 21 bp, Homo sapiens
cagcctggtttacaaattcca

SEQ ID NO: 356 - DNA, 21 bp, Homo sapiens
tggggaaaactaaggcaaagt

SEQ ID NO: 357 - DNA, 21 bp, Homo sapiens
caacaatgaagcctgctcttc

SEQ ID NO: 358 - DNA, 21 bp, Homo sapiens
cctgcttcagtgagagaatgg

SEQ ID NO: 359 - DNA, 21 bp, Homo sapiens
aggaccggttcatcaacttct

SEQ ID NO: 360 - DNA, 21 bp, Homo sapiens
tcaatgtaggactggtccgtc

SEQ ID NO: 361 - DNA, 21 bp, Homo sapiens
aaatggtgccttcaagacctt

SEQ ID NO: 362 - DNA, 21 bp, Homo sapiens
ccggcctatactcctacaagg

SEQ ID NO: 363 - DNA, 21 bp, Homo sapiens
taatggtggtctgaacaaggc

SEQ ID NO: 364 - DNA, 21 bp, Homo sapiens
agttggcccaagtccttaaaa

SEQ ID NO: 365 - DNA, 20 bp, Homo sapiens
catggaggagccatacaaca

SEQ ID NO: 366 - DNA, 20 bp, Homo sapiens
tttgtcctgctcccaaattc

SEQ ID NO: 367 - DNA, 21 bp, Homo sapiens
tgctttgtatgagaccccaac

SEQ ID NO: 368 - DNA, 21 bp, Homo sapiens
catctttctcacggatgtggt

SEQ ID NO: 369 - DNA, 21 bp, Homo sapiens
agaagacagagaggtcagccc

SEQ ID NO: 370 - DNA, 21 bp, Homo sapiens
tgggaccctaattttctggac

SEQ ID NO: 371 - DNA, 20 bp, Homo sapiens
acccttgagttttcgcctct

SEQ ID NO: 372 - DNA, 20 bp, Homo sapiens
ggatcaaagcaaaacctgga

SEQ ID NO: 373 - DNA, 21 bp, Homo sapiens
gccccttttgtataggactgc

SEQ ID NO: 374 - DNA, 21 bp, Homo sapiens
aattccagtgaggcacaaatg

SEQ ID NO: 375 - DNA, 21 bp, Homo sapiens
caagacctgccttctcatcag

SEQ ID NO: 376 - DNA, 21 bp, Homo sapiens
gaagacgtccgtctgtggata

SEQ ID NO: 377 - DNA, 21 bp, Homo sapiens
caattctctcagcagacctgg

SEQ ID NO: 378 - DNA, 21 bp, Homo sapiens
accacggagtcaaaaccttct

SEQ ID NO: 379 - DNA, 21 bp, Homo sapiens
ccccaaggcacatactgttaa

SEQ ID NO: 380 - DNA, 21 bp, Homo sapiens
tgcccattgttgaactaaagc

SEQ ID NO: 381 - DNA, 20 bp, Homo sapiens
gaacatgctgaccaagcaga

SEQ ID NO: 382 - DNA, 20 bp, Homo sapiens
cagttgtgtccacccttcct

SEQ ID NO: 383 - DNA, 21 bp, Homo sapiens
aacaatactggctgatcaccg

SEQ ID NO: 384 - DNA, 21 bp, Homo sapiens
catggagtgtgatcactgtgg

SEQ ID NO: 385 - DNA, 20 bp, Homo sapiens
ggactgcagtgtggagttca

SEQ ID NO: 386 - DNA, 20 bp, Homo sapiens
gagaggggagggagacagac

SEQ ID NO: 387 - DNA, 21 bp, Homo sapiens
ggtttataagcctttgccagg

SEQ ID NO: 388 - DNA, 21 bp, Homo sapiens
gtgggaaaagtcacactgcat

SEQ ID NO: 389 - DNA, 21 bp, Homo sapiens
ctcctcctaattgcagtgctg

SEQ ID NO: 390 - DNA, 21 bp, Homo sapiens
gtgatagattctggtgcggaa

SEQ ID NO: 391 - DNA, 20 bp, Homo sapiens
cctcaggtccaactccatgt

SEQ ID NO: 392 - DNA, 20 bp, Homo sapiens
gtgccccaatttttgatttg

SEQ ID NO: 393 - DNA, 20 bp, Homo sapiens
agccttgtctcccttggatt

SEQ ID NO: 394 - DNA, 20 bp, Homo sapiens
tcagttgcccctctacaacc

SEQ ID NO: 395 - DNA, 20 bp, Homo sapiens
aaggccctggattctcactc

SEQ ID NO: 396 - DNA, 20 bp, Homo sapiens
gccaggacaccttcagagag

SEQ ID NO: 397 - DNA, 19 bp, Homo sapiens
aagagcctcccaaaggaaa

SEQ ID NO: 398 - DNA, 20 bp, Homo sapiens
gggaaatgaaagtggcaaga

SEQ ID NO: 399 - DNA, 21 bp, Homo sapiens
ttgttggttttattctccccc

SEQ ID NO: 400 - DNA, 21 bp, Homo sapiens
cagttggaatcaaaagggaca

SEQ ID NO: 401 - DNA, 21 bp, Homo sapiens
agtgaggaagccaaagaggag

SEQ ID NO: 402 - DNA, 21 bp, Homo sapiens
tttggcagcataaatattggc

SEQ ID NO: 403 - DNA, 20 bp, Homo sapiens
cagagagggaaccaccagag

SEQ ID NO: 404 - DNA, 20 bp, Homo sapiens
ccctggggaaattaaaatga

SEQ ID NO: 405 - DNA, 20 bp, Homo sapiens
ctctgtcgggaaaggagaga

SEQ ID NO: 406 - DNA, 20 bp, Homo sapiens
gaactttgacgacaccgaca

SEQ ID NO: 407 - DNA, 21 bp, Homo sapiens
ctctggccagagataccacag

SEQ ID NO: 408 - DNA, 21 bp, Homo sapiens
catcaagggtttgttgcttgt

SEQ ID NO: 409 - DNA, 21 bp, Homo sapiens
aactatgtggccgacattgag

SEQ ID NO: 410 - DNA, 21 bp, Homo sapiens
caccgagaagcacatgagaat

SEQ ID NO: 411 - DNA, 21 bp, Homo sapiens
cctgaagaaccgtgatgtcat

SEQ ID NO: 412 - DNA, 21 bp, Homo sapiens
ctgtgctctggatgaggtagc

SEQ ID NO: 413 - DNA, 21 bp, Homo sapiens
cacatcccctttcttgacaaa

SEQ ID NO: 414 - DNA, 21 bp, Homo sapiens
gatgaggcactcagtgaggag

SEQ ID NO: 415 - DNA, 21 bp, Homo sapiens
ttgaaacctaattttgtggcg

SEQ ID NO: 416 - DNA, 21 bp, Homo sapiens
aaatgttgacacgtctcctgg

SEQ ID NO: 417 - DNA, 21 bp, Homo sapiens
cctaataccatcgacgtccct

SEQ ID NO: 418 - DNA, 21 bp, Homo sapiens
agctctgggactaatcaccgt

SEQ ID NO: 419 - DNA, 21 bp, Homo sapiens
aaaaggctgacaaactgacca

SEQ ID NO: 420 - DNA, 21 bp, Homo sapiens
tcacagcctaggtaagagcca

SEQ ID NO: 421 - DNA, 21 bp, Homo sapiens
caggtacgaattttgcggtta

SEQ ID NO: 422 - DNA, 21 bp, Homo sapiens
tcgcaatccactctctgactt

SEQ ID NO: 423 - DNA, 21 bp, Homo sapiens
ctccttcagcttcatggtcag

SEQ ID NO: 424 - DNA, 21 bp, Homo sapiens
tctggctcagagtcatccagt

SEQ ID NO: 425 - DNA, 21 bp, Homo sapiens
caacccagcagattttgtcat

SEQ ID NO: 426 - DNA, 21 bp, Homo sapiens
cgaggtctctcttgtggtctg

SEQ ID NO: 427 - DNA, 21 bp, Homo sapiens
tctttgcattgagattggtcc

SEQ ID NO: 428 - DNA, 21 bp, Homo sapiens
accgtgaaaaatgcacatctc

SEQ ID NO: 429 - DNA, 21 bp, Homo sapiens
ccttcaatccgtcctatgaca

SEQ ID NO: 430 - DNA, 21 bp, Homo sapiens
ggaagcagctcttcaatgttg

SEQ ID NO: 431 - DNA, 21 bp, Homo sapiens
gagtgaatgcagtaaacccca

SEQ ID NO: 432 - DNA, 21 bp, Homo sapiens
cactcagcagaaagaggatgg

SEQ ID NO: 433 - DNA, 21 bp, Homo sapiens
catcgaggacgctacttcaag

SEQ ID NO: 434 - DNA, 21 bp, Homo sapiens
aaaataggcctgacgacacct

SEQ ID NO: 435 - DNA, 21 bp, Homo sapiens
ttggacaaactgggaagattg

SEQ ID NO: 436 - DNA, 21 bp, Homo sapiens
acgtactgggcatagtgcatc

SEQ ID NO: 437 - DNA, 21 bp, Homo sapiens
ggggatattattagcgtggga

SEQ ID NO: 438 - DNA, 21 bp, Homo sapiens
tgccgcttctacttctggtaa

SEQ ID NO: 439 - DNA, 21 bp, Homo sapiens
tccactcacatttcctatcgg

SEQ ID NO: 440 - DNA, 21 bp, Homo sapiens
gattccatttacggggaaaaa

SEQ ID NO: 441 - DNA, 21 bp, Homo sapiens
aacctgcatggactgtgaaac

SEQ ID NO: 442 - DNA, 21 bp, Homo sapiens
aatatcaagtgccccttccag

SEQ ID NO: 443 - DNA, 21 bp, Homo sapiens
gcaagtatagcgcatttgagc

SEQ ID NO: 444 - DNA, 21 bp, Homo sapiens
cgtcttgaagtccatggagag

SEQ ID NO: 445 - DNA, 21 bp, Homo sapiens
ttagatctgaagccctgggtt

SEQ ID NO: 446 - DNA, 21 bp, Homo sapiens
tgcttggtgaacataacacca

SEQ ID NO: 447 - DNA, 21 bp, Homo sapiens
agaagaaaaacccaaatggca

SEQ ID NO: 448 - DNA, 22 bp, Homo sapiens
tccatagtggtttttaccagca

SEQ ID NO: 449 - DNA, 21 bp, Homo sapiens
tgcgtaccaggattggttaag

SEQ ID NO: 450 - DNA, 21 bp, Homo sapiens
gatgtccaacaaaacgctcat

SEQ ID NO: 451 - DNA, 21 bp, Homo sapiens
tgagcatggtatacttttggg

SEQ ID NO: 452 - DNA, 21 bp, Homo sapiens
aagcttataggaatgggccag

SEQ ID NO: 453 - DNA, 21 bp, Homo sapiens
tgggaaaatttaaaacccaca

SEQ ID NO: 454 - DNA, 21 bp, Homo sapiens
tcaaagtgccctttggtagtg

SEQ ID NO: 455 - DNA, 21 bp, Homo sapiens
tcctcaaacacaaaatcccag

SEQ ID NO: 456 - DNA, 21 bp, Homo sapiens
ctcctactatgggcctccaac

SEQ ID NO: 457 - DNA, 21 bp, Homo sapiens
gaagcagatcgtcctgaactg

SEQ ID NO: 458 - DNA, 21 bp, Homo sapiens
gctcatcatcctcttctccct

SEQ ID NO: 459 - DNA, 21 bp, Homo sapiens
tcccaatagcttgtggatcag

SEQ ID NO: 460 - DNA, 21 bp, Homo sapiens
atcaaccaggaagccaacttt

SEQ ID NO: 461 - DNA, 21 bp, Homo sapiens
gaccaacacctctcctaaggg

SEQ ID NO: 462 - DNA, 21 bp, Homo sapiens
gttgggaggggaccatagtta

SEQ ID NO: 463 - DNA, 21 bp, Homo sapiens
gaaatagcaaaaacaaggccc

SEQ ID NO: 464 - DNA, 21 bp, Homo sapiens
caatgcagcacatgctagaaa

SEQ ID NO: 465 - DNA, 21 bp, Homo sapiens
cagaatgtaaagggtggggat

SEQ ID NO: 466 - DNA, 21 bp, Homo sapiens
ccctgagacctggtttacctc

SEQ ID NO: 467 - DNA, 21 bp, Homo sapiens
gatggcagctatgaagtcctg

SEQ ID NO: 468 - DNA, 21 bp, Homo sapiens
gcattccagctatcacctgaa

SEQ ID NO: 469 - DNA, 21 bp, Homo sapiens
cacctctactccctgcacatc

SEQ ID NO: 470 - DNA, 21 bp, Homo sapiens
agaagagatgacactcggggt

SEQ ID NO: 471 - DNA, 21 bp, Homo sapiens
tttggctaaagacccgaaaat

SEQ ID NO: 472 - DNA, 21 bp, Homo sapiens
tctctctctctcggtgatgga

SEQ ID NO: 473 - DNA, 21 bp, Homo sapiens
gagcaggaaagatgatgcaag

SEQ ID NO: 474 - DNA, 21 bp, Homo sapiens
aagtatctgagatggcccgat

SEQ ID NO: 475 - DNA, 21 bp, Homo sapiens
ctctggaatggactgaagctg

SEQ ID NO: 476 - DNA, 21 bp, Homo sapiens
aaaagtccaggagctggagag

SEQ ID NO: 477 - DNA, 21 bp, Homo sapiens
cacctcatcacaacaccctct

SEQ ID NO: 478 - DNA, 21 bp, Homo sapiens
tgctaggatccaccctcctat

SEQ ID NO: 479 - DNA, 21 bp, Homo sapiens
ctcttcccagctcctgattct

SEQ ID NO: 480 - DNA, 21 bp, Homo sapiens
ctgaaggactgaagggagctt

SEQ ID NO: 481 - DNA, 21 bp, Homo sapiens
acatgctgtgtggtagaggct

SEQ ID NO: 482 - DNA, 21 bp, Homo sapiens
aacatgcatgcattgtaccaa

SEQ ID NO: 483 - DNA, 21 bp, Homo sapiens
ttccaggaagaacatcattgc

SEQ ID NO: 484 - DNA, 21 bp, Homo sapiens
cttttccttcagggaaccaag

SEQ ID NO: 485 - DNA, 21 bp, Homo sapiens
ttctcagccaaagcagatgtt

SEQ ID NO: 486 - DNA, 21 bp, Homo sapiens
tgcttctcctcagcaatttgt

SEQ ID NO: 487 - DNA, 21 bp, Homo sapiens
actatgggatgtgtggcagag

SEQ ID NO: 488 - DNA, 21 bp, Homo sapiens
gctcttttaaagccgcttcat

SEQ ID NO: 489 - DNA, 21 bp, Homo sapiens
aaagaggctgaccttccagag

SEQ ID NO: 490 - DNA, 21 bp, Homo sapiens
aaggcaaggcctatttttcaa

SEQ ID NO: 491 - DNA, 21 bp, Homo sapiens
gaagcaatgaatagcatggga

SEQ ID NO: 492 - DNA, 21 bp, Homo sapiens
ccattcctccagtcacactgt

SEQ ID NO: 493 - DNA, 21 bp, Homo sapiens
tcggtcttggctacttgaaga

SEQ ID NO: 494 - DNA, 21 bp, Homo sapiens
cagcgttccagaaaatctgag

SEQ ID NO: 495 - DNA, 21 bp, Homo sapiens
aaggagttgctactcaagccc

SEQ ID NO: 496 - DNA, 21 bp, Homo sapiens
cttgtaatactggcggatgga

SEQ ID NO: 497 - DNA, 21 bp, Homo sapiens
ccatccttgggtgtaggctat

SEQ ID NO: 498 - DNA, 21 bp, Homo sapiens
ctcgaagtatcgatccagcag

SEQ ID NO: 499 - DNA, 21 bp, Homo sapiens
atgtgccctcacatctgtttc

SEQ ID NO: 500 - DNA, 21 bp, Homo sapiens
gggttttaacagcagggtagc

SEQ ID NO: 501 - DNA, 21 bp, Homo sapiens
gaaatcagtctaccaaggggc

SEQ ID NO: 502 - DNA, 21 bp, Homo sapiens
cgactttgcaatcttgacaca

SEQ ID NO: 503 - DNA, 21 bp, Homo sapiens
gaagagtgggcaaacatgaaa

SEQ ID NO: 504 - DNA, 21 bp, Homo sapiens
cccacctgggagtaagtcttc

SEQ ID NO: 505 - DNA, 21 bp, Homo sapiens
ccaggtgacctaccagttgaa

SEQ ID NO: 506 - DNA, 21 bp, Homo sapiens
ttccaccaccacttttgtagc

SEQ ID NO: 507 - DNA, 21 bp, Homo sapiens
tggcaaacactggaatcctac

SEQ ID NO: 508 - DNA, 21 bp, Homo sapiens
tctgtagagaggtggctccaa

SEQ ID NO: 509 - DNA, 21 bp, Homo sapiens
cggatgctcagcatcttctac

SEQ ID NO: 510 - DNA, 21 bp, Homo sapiens
actaccaggaacagcagcaga

SEQ ID NO: 511 - DNA, 21 bp, Homo sapiens
aggcaatccgatttacgactt

SEQ ID NO: 512 - DNA, 21 bp, Homo sapiens
ctctgcctccttcatcaacag

SEQ ID NO: 513 - DNA, 21 bp, Homo sapiens
agaaggacttctccagcaagg

SEQ ID NO: 514 - DNA, 21 bp, Homo sapiens
ctgggacagaatggacagtgt

SEQ ID NO: 515 - DNA, 20 bp, Homo sapiens
tggccattcagacagcatta

SEQ ID NO: 516 - DNA, 20 bp, Homo sapiens
cagctacttgggaggctgag

SEQ ID NO: 517 - DNA, 20 bp, Homo sapiens
gggcccacttgactcattta

SEQ ID NO: 518 - DNA, 21 bp, Homo sapiens
gcctgcagagatctcactttg

SEQ ID NO: 519 - DNA, 21 bp, Homo sapiens
acaggatgggcctctctatgt

SEQ ID NO: 520 - DNA, 21 bp, Homo sapiens
tcctcaggaacacggttaatg

SEQ ID NO: 521 - DNA, 21 bp, Homo sapiens
acaccttggtaccaccaatca

SEQ ID NO: 522 - DNA, 21 bp, Homo sapiens
ggtctcttgccttcatccagt

SEQ ID NO: 523 - DNA, 20 bp, Homo sapiens
gcatcgccttcttcatcttc

SEQ ID NO: 524 - DNA, 20 bp, Homo sapiens
cgtagctgccttctctggtc

SEQ ID NO: 525 - DNA, 21 bp, Homo sapiens
ttcatgcgtgaaagtgtgaag

SEQ ID NO: 526 - DNA, 22 bp, Homo sapiens
tttgatcaaagggtgtcatcag

SEQ ID NO: 527 - DNA, 20 bp, Homo sapiens
ggtagggagcttctcagcaa

SEQ ID NO: 528 - DNA, 20 bp, Homo sapiens
gttagcccagaggagctcaa

SEQ ID NO: 529 - DNA, 20 bp, Homo sapiens
cacagaaaacacccccactt

SEQ ID NO: 530 - DNA, 20 bp, Homo sapiens
actgtatggaggcccagttg

SEQ ID NO: 531 - DNA, 17 bp, Homo sapiens
agccgagccacatcgct

SEQ ID NO: 532 - DNA, 19 bp, Homo sapiens
gtgaccaggcgcccaatac

SEQ ID NO: 533 - DNA, 28 bp, Homo sapiens
caaatccgttgactccgaccttcacctt

SEQ ID NO: 534 - DNA, 21 bp, Artificial Sequence
  Synthesized Oligonucleotide.
cagggcaacaucuacaagctt

SEQ ID NO: 535 - DNA, 21 bp, Artificial Sequence
  Synthesized Oligonucleotide.
gcaaguguacgacgcgcactt

SEQ ID NO: 536 - DNA, 21 bp, Artificial Sequence
  Synthesized Oligonucleotide.
ccgcuugcugucugcccuctt

SEQ ID NO: 537 - DNA, 21 bp, Artificial Sequence
  Synthesized Oligonucleotide.
caucugggcaguuguaccatt

SEQ ID NO: 538 - DNA, 21 bp, Artificial Sequence
  Synthesized Oligonucleotide.
cuacgcacuccuuugacaatt

SEQ ID NO: 539 - DNA, 21 bp, Artificial Sequence
  Synthesized Oligonucleotide.
aguguggaucugcagccautt

SEQ ID NO: 540 - DNA, 21 bp, Artificial Sequence
  Synthesized Oligonucleotide.
guuccugacgguguuccugtt

SEQ ID NO: 541 - DNA, 21 bp, Artificial Sequence
  Synthesized Oligonucleotide.
uugcgggaauucucuuugctt

SEQ ID NO: 542 - DNA, 21 bp, Artificial Sequence
  Synthesized Oligonucleotide.
ggaagugguacugcuggactt

SEQ ID NO: 543 - DNA, 21 bp, Artificial Sequence
  Synthesized Oligonucleotide.
cuuccagaagcgccuguuctt

SEQ ID NO: 544 - DNA, 21 bp, Artificial Sequence
  Synthesized Oligonucleotide.
gagccccguaugcacugugtt

SEQ ID NO: 545 - DNA, 21 bp, Artificial Sequence
  Synthesized Oligonucleotide.
cuacaccuucaccguggagtt

SEQ ID NO: 546 - DNA, 21 bp, Artificial Sequence
  Synthesized Oligonucleotide.
gcuuguagauguugcccugtt

SEQ ID NO: 547 - DNA, 21 bp, Artificial Sequence
  Synthesized Oligonucleotide.
gugcgcgucguacacuugctt

SEQ ID NO: 548 - DNA, 21 bp, Artificial Sequence
  Synthesized Oligonucleotide.
gagggcagacagcaagcggtt

SEQ ID NO: 549 - DNA, 21 bp, Artificial Sequence
  Synthesized Oligonucleotide.
ugguacaacugcccagaugtt

SEQ ID NO: 550 - DNA, 21 bp, Artificial Sequence
  Synthesized Oligonucleotide.
uugucaaaggagugcguagtt

SEQ ID NO: 551 - DNA, 21 bp, Artificial Sequence
  Synthesized Oligonucleotide.
auggcugcagauccacacutt

SEQ ID NO: 552 - DNA, 21 bp, Artificial Sequence
  Synthesized Oligonucleotide.
caggaacaccgucaggaactt

SEQ ID NO: 553 - DNA, 21 bp, Artificial Sequence
  Synthesized Oligonucleotide.
gcaaagagaauucccgcaatt

SEQ ID NO: 554 - DNA, 21 bp, Artificial Sequence
  Synthesized Oligonucleotide.
guccagcaguaccacuucctt

SEQ ID NO: 555 - DNA, 21 bp, Artificial Sequence
  Synthesized Oligonucleotide.
gaacaggcgcuucuggaagtt

SEQ ID NO: 556 - DNA, 21 bp, Artificial Sequence
  Synthesized Oligonucleotide.
cacagugcauacggggcuctt

SEQ ID NO: 557 - DNA, 21 bp, Artificial Sequence
  Synthesized Oligonucleotide.
cuccacggugaagguguagtt

What is claimed is:

1. A method of identifying breast cancer cells that are either resistant or sensitive to inhibition of cellular proliferation by a protein tyrosine kinase inhibitor comprising the steps of:
    (a) determining the expression of a gene expression product from the EphA2 gene in breast cancer cells,
    (b) normalizing the value of the expression of said gene expression product from the EphA2 gene to an internal control gene that is GADPH or other housekeeping gene;
    (c) comparing the normalized value for said gene expression product from the EphA2 gene to the average normalized expression value of said gene expression product from the EphA2 gene in a panel of control breast cancer cells,
    wherein said panel of control breast cancer cells consist of a plurality of breast cancer cells that are sensitive and a plurality of breast cancer cells that are resistant to said protein tyrosine kinase inhibitor; and
    (d) predicting whether said breast cancer cells are resistant or sensitive to inhibition of cellular proliferation by the protein tyrosine kinase inhibitor,
    wherein a normalized expression level of said gene expression product from the EphA2 gene in said breast cancer cells that is higher, relative to the average normalized expression level of said gene expression product from the EphA2 gene in said panel of control breast cancer cells, is indicative of sensitivity to the protein tyrosine kinase inhibitor, while a normalized expression level of said gene expression product from the EphA2 gene in said breast cancer cells that is lower, relative to the average normalized expression level of said gene expression product from the EphA2 gene in said panel of control breast cancer cells, is indicative of resistance to the protein tyrosine kinase inhibitor, and
    wherein said protein tyrosine kinase inhibitor is an inhibitor of Src, Fgr, Fyn, Yes, Blk, Hck, Lck, Lyn, BCR-ABL, PDGFR, c-Kit, and EphA2.

* * * * *